United States Patent
Anderson et al.

(10) Patent No.: US 11,274,320 B2
(45) Date of Patent: Mar. 15, 2022

(54) BIOSYNTHESIS OF CANNABINOIDS AND CANNABINOID PRECURSORS

(71) Applicant: Ginkgo Bioworks, Inc., Boston, MA (US)

(72) Inventors: Kim Cecelia Anderson, Boston, MA (US); Elena Brevnova, Boston, MA (US); Dylan Alexander Carlin, Boston, MA (US); Brian Carvalho, Boston, MA (US); Nicholas Flores, Boston, MA (US); Katrina Forrest, Boston, MA (US); Massimo Merighi, Boston, MA (US); Gabriel Rodriguez, Boston, MA (US); Emily E. Wrenbeck, Boston, MA (US)

(73) Assignee: Ginkgo Bioworks, Inc., Boston, MA (US)

(*) Notice: Subject to any disclaimer, the term of this patent is extended or adjusted under 35 U.S.C. 154(b) by 0 days.

(21) Appl. No.: 17/078,872

(22) Filed: Oct. 23, 2020

(65) Prior Publication Data

US 2021/0071209 A1 Mar. 11, 2021

Related U.S. Application Data

(63) Continuation of application No. PCT/US2020/019760, filed on Feb. 25, 2020.

(60) Provisional application No. 62/810,938, filed on Feb. 26, 2019, provisional application No. 62/810,367, filed on Feb. 25, 2019.

(51) Int. Cl.
| | | |
|---|---|---|
| A61K 31/352 | (2006.01) |
| C12P 7/22 | (2006.01) |
| C12M 1/34 | (2006.01) |
| C12N 1/16 | (2006.01) |
| A61K 38/00 | (2006.01) |
| C12N 1/18 | (2006.01) |
| C12R 1/865 | (2006.01) |

(52) U.S. Cl.
CPC ............ C12P 7/22 (2013.01); C12M 41/30 (2013.01); C12N 1/16 (2013.01); C12N 1/185 (2021.05); C12R 2001/865 (2021.05)

(58) Field of Classification Search
CPC ............ C12N 9/1037; C12Y 203/01206
See application file for complete search history.

(56) References Cited

U.S. PATENT DOCUMENTS

| | | | |
|---|---|---|---|
| 3,897,306 A | 7/1975 | Vidic et al. |
| 6,033,883 A | 3/2000 | Barr et al. |
| 6,265,633 B1 | 7/2001 | Okada et al. |
| 7,323,576 B2 | 1/2008 | Souza et al. |
| 7,344,736 B2 | 3/2008 | Whittle et al. |
| 7,361,483 B2 | 4/2008 | Kuzuyama et al. |
| 7,544,498 B2 | 6/2009 | Kuzuyama et al. |
| 7,659,097 B2 | 2/2010 | Renninger et al. |
| 7,723,088 B2 | 5/2010 | Nagel et al. |
| 8,093,028 B2 | 1/2012 | Thorson et al. |
| 8,124,390 B2 | 2/2012 | Kuzuyama et al. |
| 8,618,355 B2 | 12/2013 | Page et al. |
| 8,808,734 B2 | 8/2014 | Winnicki |
| 8,883,445 B2 | 11/2014 | Contreras et al. |
| 8,884,100 B2 | 11/2014 | Page et al. |
| 9,029,636 B2 | 5/2015 | Wu et al. |
| 9,095,555 B2 | 8/2015 | Winnicki |
| 9,359,625 B2 | 6/2016 | Winnicki et al. |
| 9,394,510 B2 | 7/2016 | Peet et al. |
| 9,394,520 B2 | 7/2016 | Calvi et al. |
| 9,512,391 B2 | 12/2016 | Peet et al. |
| 9,526,715 B1 | 12/2016 | Winnicki et al. |
| 9,546,362 B2 | 1/2017 | Page et al. |
| 9,587,212 B2 | 3/2017 | Winnicki et al. |
| 9,611,460 B2 | 4/2017 | Page et al. |
| 9,637,763 B2 | 5/2017 | Barr |
| 9,765,308 B2 | 9/2017 | Page et al. |
| 9,822,374 B2 | 11/2017 | Katz et al. |
| 9,822,384 B2 | 11/2017 | Poulos et al. |
| 9,861,609 B2 | 1/2018 | Winnicki et al. |
| 9,879,292 B2 | 1/2018 | Winnicki et al. |
| 9,908,832 B2 | 3/2018 | Leker et al. |
| 9,934,510 B2 | 4/2018 | Collins et al. |
| 10,030,258 B2 | 7/2018 | Kim et al. |
| 10,052,303 B2 | 8/2018 | Winnicki |
| 10,059,971 B2 | 8/2018 | Page et al. |
| 10,081,818 B2 | 9/2018 | Peet et al. |
| 10,093,949 B2 | 10/2018 | Poulos et al. |
| 10,119,126 B2 | 11/2018 | Marty et al. |

(Continued)

FOREIGN PATENT DOCUMENTS

| | | |
|---|---|---|
| CA | 2321180 A1 | 8/1999 |
| CA | 2568367 A1 | 12/2005 |

(Continued)

OTHER PUBLICATIONS

Wang et al. (2014) Temporal and spatial regulation of anthocyanin biosynthesis provide diverse flower colour intensities and patterning in Cymbidium orchid, Planta, vol. 240, pp. 983-1002.*
Kearsey L.J. (2017) Structural and Biochemical Characterization of Members of the Cannabinoid Biosynthetic Pathway to Inform their Application in Synthetic Biology, A thesis submitted to University of Manchester, pp. 1-115.*
Go et al. (2020) Cannabinoid Biosynthesis using Noncanonical Cannabinoid Synthases, pp. 1-19.*
International Search Report and Written Opinion dated May 29, 2020, for Application No. PCT/US2020/019760.

(Continued)

*Primary Examiner* — Scarlett Y Goon
*Assistant Examiner* — Samuel W Liu
(74) *Attorney, Agent, or Firm* — Wolf, Greenfield & Sacks, P.C.

(57) ABSTRACT

Aspects of the disclosure relate to biosynthesis of cannabinoids and cannabinoid precursors in recombinant cells and in vitro.

20 Claims, 27 Drawing Sheets
Specification includes a Sequence Listing.

(56) References Cited

U.S. PATENT DOCUMENTS

| | | |
|---|---|---|
| 10,125,381 B2 | 11/2018 | Barr et al. |
| 10,138,492 B2 | 11/2018 | Nadzan et al. |
| 10,143,706 B2 | 12/2018 | Kotra et al. |
| 10,159,908 B2 | 12/2018 | Thomas et al. |
| 10,190,140 B2 | 1/2019 | Tange et al. |
| 10,214,753 B2 | 2/2019 | Peet et al. |
| 10,336,978 B2 | 7/2019 | Peet et al. |
| 10,364,416 B2 | 7/2019 | Page et al. |
| 10,392,635 B2 | 8/2019 | Poulos et al. |
| 10,392,673 B2 | 8/2019 | Kino et al. |
| 10,428,344 B2 | 10/2019 | Nadzan et al. |
| 10,435,727 B2 | 10/2019 | Butt et al. |
| 10,472,652 B2 | 11/2019 | Peet et al. |
| 10,519,460 B2 | 12/2019 | Frandsen et al. |
| 10,563,211 B2 | 2/2020 | Keasling et al. |
| 10,633,681 B2 | 4/2020 | Winnicki et al. |
| 10,704,066 B2 | 7/2020 | Rudenko et al. |
| 10,718,000 B2 | 7/2020 | Page et al. |
| 10,724,009 B2 | 7/2020 | Page et al. |
| 10,837,031 B2 | 11/2020 | Barr et al. |
| 10,894,952 B2 | 1/2021 | Mendez et al. |
| 10,954,534 B2 | 3/2021 | Poulos et al. |
| 10,975,379 B2 | 4/2021 | Keasling et al. |
| 11,028,417 B1 | 6/2021 | Butt et al. |
| 11,041,002 B1 | 6/2021 | Scott et al. |
| 11,046,978 B2 | 6/2021 | Gonzalez et al. |
| 2002/0142391 A1 | 10/2002 | Kivirikko et al. |
| 2006/0088903 A1 | 4/2006 | Lang et al. |
| 2006/0112454 A1 | 5/2006 | Christensen et al. |
| 2006/0236421 A1 | 10/2006 | Pennell et al. |
| 2007/0105086 A1 | 5/2007 | Qin et al. |
| 2009/0042974 A1 | 2/2009 | Parker et al. |
| 2009/0275649 A1 | 11/2009 | Qin et al. |
| 2010/0003237 A1 | 1/2010 | Keller et al. |
| 2010/0166700 A1 | 7/2010 | Charles |
| 2010/0298579 A1 | 11/2010 | Steup et al. |
| 2012/0144523 A1 | 6/2012 | Page et al. |
| 2012/0322114 A1 | 12/2012 | Liu et al. |
| 2013/0067619 A1 | 3/2013 | Page et al. |
| 2013/0333061 A1 | 12/2013 | Wu et al. |
| 2014/0057251 A1 | 2/2014 | McKernan |
| 2014/0141476 A1 | 5/2014 | Page et al. |
| 2014/0152530 A1 | 6/2014 | Venkatesha et al. |
| 2014/0273109 A1 | 9/2014 | Smolke et al. |
| 2015/0159144 A1 | 6/2015 | Birikh et al. |
| 2015/0275207 A1 | 10/2015 | Way et al. |
| 2015/0361469 A1 | 12/2015 | Winnicki et al. |
| 2016/0025753 A1* | 1/2016 | Khosropour ..... G01N 33/54306 506/9 |
| 2016/0030387 A1 | 2/2016 | Winnicki |
| 2016/0145563 A1 | 5/2016 | Berteau et al. |
| 2016/0177404 A1 | 6/2016 | McKernan |
| 2016/0264917 A1 | 9/2016 | Peet et al. |
| 2016/0279073 A1 | 9/2016 | Donsky et al. |
| 2016/0298151 A1 | 10/2016 | Butt et al. |
| 2016/0355854 A1 | 12/2016 | Winnicki et al. |
| 2017/0152530 A1 | 6/2017 | Peet et al. |
| 2017/0159080 A1 | 6/2017 | Peet et al. |
| 2017/0161041 A1 | 6/2017 | Kawahito et al. |
| 2017/0196985 A1 | 7/2017 | Dong et al. |
| 2017/0211049 A1 | 7/2017 | Page et al. |
| 2017/0233778 A1 | 8/2017 | Winnicki et al. |
| 2017/0233779 A1 | 8/2017 | Page et al. |
| 2017/0247650 A1 | 8/2017 | Peet et al. |
| 2017/0283837 A1 | 10/2017 | Kavarana et al. |
| 2017/0298399 A1 | 10/2017 | Peet et al. |
| 2017/0362195 A1 | 12/2017 | Peet et al. |
| 2018/0073043 A1 | 3/2018 | Poulos et al. |
| 2018/0142216 A1 | 5/2018 | Naesby et al. |
| 2018/0155748 A1 | 6/2018 | Butt et al. |
| 2018/0171394 A1 | 6/2018 | Sawler et al. |
| 2018/0179564 A1 | 6/2018 | Winnicki et al. |
| 2018/0221522 A1 | 8/2018 | Eades |
| 2018/0230499 A1 | 8/2018 | Peet et al. |
| 2018/0258439 A1 | 9/2018 | Boudko et al. |
| 2018/0305709 A1 | 10/2018 | Frandsen et al. |
| 2018/0312886 A1 | 11/2018 | Lynch et al. |
| 2018/0312887 A1 | 11/2018 | Lynch et al. |
| 2018/0320209 A1 | 11/2018 | Rudenko et al. |
| 2018/0334649 A1 | 11/2018 | Goebl et al. |
| 2018/0334692 A1* | 11/2018 | Barr ..................... C12N 9/93 |
| 2018/0346866 A1 | 12/2018 | Peet et al. |
| 2018/0353463 A1 | 12/2018 | Winnicki |
| 2018/0371507 A1 | 12/2018 | Poulos et al. |
| 2019/0002848 A1 | 1/2019 | Gonzalez et al. |
| 2019/0017101 A1 | 1/2019 | Jackson |
| 2019/0060300 A1* | 2/2019 | Anavi-Goffer ...... A61K 31/085 |
| 2019/0078168 A1 | 3/2019 | Sayre et al. |
| 2019/0085347 A1 | 3/2019 | Sayre et al. |
| 2019/0169661 A1* | 6/2019 | Page ..................... C12P 7/42 |
| 2019/0185946 A1 | 6/2019 | McKernan |
| 2019/0300888 A1 | 10/2019 | Keasling et al. |
| 2019/0338301 A1 | 11/2019 | Sayre et al. |
| 2019/0367953 A1 | 12/2019 | Mookerjee et al. |
| 2019/0382708 A1 | 12/2019 | Peet et al. |
| 2019/0382734 A1 | 12/2019 | Page et al. |
| 2019/0382813 A1 | 12/2019 | Davidovich et al. |
| 2020/0017889 A1 | 1/2020 | Poulos et al. |
| 2020/0035118 A1 | 1/2020 | Pandolfino |
| 2020/0035119 A1 | 1/2020 | Pandolfino |
| 2020/0048664 A1 | 2/2020 | Peet et al. |
| 2020/0063170 A1 | 2/2020 | Butt et al. |
| 2020/0063171 A1 | 2/2020 | Butt et al. |
| 2020/0071732 A1 | 3/2020 | Poulos et al. |
| 2020/0080115 A1 | 3/2020 | Clark et al. |
| 2020/0123511 A1 | 4/2020 | Mendez et al. |
| 2020/0165641 A1 | 5/2020 | Buck |
| 2020/0165644 A1 | 5/2020 | Mikheev et al. |
| 2020/0172917 A1 | 6/2020 | Keasling et al. |
| 2020/0239916 A1 | 7/2020 | Mookerjee et al. |
| 2020/0289458 A1* | 9/2020 | Wong ................. A61K 31/4164 |
| 2020/0325508 A1 | 10/2020 | Page et al. |
| 2021/0040512 A1 | 2/2021 | Barr et al. |
| 2021/0080441 A1* | 3/2021 | Bryant, Jr ............. G01N 33/15 |
| 2021/0189402 A1 | 6/2021 | Carscallen et al. |
| 2021/0189444 A1 | 6/2021 | Alviar et al. |
| 2021/0238561 A1 | 8/2021 | Botsch et al. |
| 2021/0254030 A1 | 8/2021 | Noble et al. |

FOREIGN PATENT DOCUMENTS

| | | |
|---|---|---|
| CA | 2621922 A1 | 3/2007 |
| CA | 2715397 A1 | 8/2009 |
| CA | 2718469 A1 | 9/2009 |
| CA | 2770774 A1 | 2/2011 |
| CA | 2796465 A1 | 10/2011 |
| CA | 2851316 A1 | 1/2013 |
| CA | 3012383 A1 | 9/2014 |
| CA | 2929280 A1 | 5/2015 |
| CA | 2957953 A1 | 12/2015 |
| CA | 2990071 A1 | 1/2016 |
| CA | 2959283 A1 | 3/2016 |
| CA | 3012054 A1 | 9/2017 |
| CA | 3019890 A1 | 10/2017 |
| CA | 3021139 A1 | 10/2017 |
| CA | 3027913 A1 | 12/2017 |
| CA | 2902452 C | 9/2018 |
| CA | 3056929 A1 | 9/2018 |
| CA | 2669453 C | 11/2018 |
| CA | 3059797 A1 | 11/2018 |
| CA | 3061718 A1 | 11/2018 |
| CA | 3062645 A1 | 11/2018 |
| CA | 3069449 A1 | 1/2019 |
| CA | 3074510 A1 | 4/2019 |
| CA | 3078505 A1 | 4/2019 |
| CA | 3098351 A1 | 10/2019 |
| CA | 3079760 A1 | 11/2019 |
| CN | 1597960 A | 3/2005 |
| CN | 112280699 A | 1/2021 |
| CN | 112410235 A | 2/2021 |
| EP | 2961402 A1 | 1/2016 |
| EP | 3062774 A2 | 9/2016 |
| EP | 3067058 A1 | 9/2016 |
| EP | 3161140 A1 | 5/2017 |

(56) References Cited

FOREIGN PATENT DOCUMENTS

| | | |
|---|---|---|
| EP | 3186383 A1 | 7/2017 |
| EP | 2732037 B1 | 12/2017 |
| EP | 3615667 A1 | 3/2020 |
| EP | 3619301 A1 | 3/2020 |
| EP | 3622059 A1 | 3/2020 |
| EP | 3652327 A1 | 5/2020 |
| EP | 3762487 A1 | 1/2021 |
| GR | 20130100326 A | 12/2014 |
| JP | 2000-078979 A | 3/2000 |
| JP | 2001-029082 A | 2/2001 |
| WO | WO 2000/063391 A2 | 10/2000 |
| WO | WO 2002/077179 A2 | 10/2002 |
| WO | WO 2002/033060 A3 | 8/2003 |
| WO | WO 2006/081537 A2 | 8/2006 |
| WO | WO 2006/132555 A1 | 12/2006 |
| WO | WO 2007/053526 A1 | 5/2007 |
| WO | WO 2010/003238 A1 | 1/2010 |
| WO | WO 2011/017798 A1 | 2/2011 |
| WO | WO 2011/127589 A1 | 10/2011 |
| WO | WO 2013/006953 A1 | 1/2013 |
| WO | WO 2013/154721 A1 | 10/2013 |
| WO | WO 2014/134281 A1 | 9/2014 |
| WO | WO 2014/195521 A2 | 12/2014 |
| WO | WO 2015/065544 A1 | 5/2015 |
| WO | WO 2015/068052 A3 | 9/2015 |
| WO | WO 2015/196275 A1 | 12/2015 |
| WO | WO 2016/010827 A1 | 1/2016 |
| WO | WO 2016/021044 A1 | 2/2016 |
| WO | WO 2016/030828 A1 | 3/2016 |
| WO | WO 2016/094810 A2 | 6/2016 |
| WO | WO 2016/189384 A1 | 12/2016 |
| WO | WO 2016/197258 A1 | 12/2016 |
| WO | WO 2016/198623 A1 | 12/2016 |
| WO | WO 2017/020043 A2 | 2/2017 |
| WO | WO 2017/139496 A1 | 8/2017 |
| WO | WO 2017/161041 A1 | 9/2017 |
| WO | WO 2017/175064 A1 | 10/2017 |
| WO | WO 2017/181118 A1 | 10/2017 |
| WO | WO 2017/190249 A1 | 11/2017 |
| WO | WO 2017/216362 A1 | 12/2017 |
| WO | WO 2018/000864 A1 | 1/2018 |
| WO | WO 2018/035450 A1 | 2/2018 |
| WO | WO 2018/076055 A1 | 5/2018 |
| WO | WO 2018/115962 A1 | 6/2018 |
| WO | WO 2018/148848 A1 | 8/2018 |
| WO | WO 2018/148849 A1 | 8/2018 |
| WO | WO 2018/176055 A2 | 9/2018 |
| WO | WO 2018/200864 A1 | 11/2018 |
| WO | WO 2018/200888 A1 | 11/2018 |
| WO | WO 2018/204859 A1 | 11/2018 |
| WO | WO 2018/205022 A1 | 11/2018 |
| WO | WO 2018/208875 A1 | 11/2018 |
| WO | WO 2018/209143 A1 | 11/2018 |
| WO | WO 2019/014395 A1 | 1/2019 |
| WO | WO 2019/014490 A1 | 1/2019 |
| WO | WO 2019/046941 A1 | 3/2019 |
| WO | WO 2019/071000 A1 | 4/2019 |
| WO | WO 2019/100007 A1 | 5/2019 |
| WO | WO 2019/173770 A1 | 9/2019 |
| WO | WO 2019/183152 A1 | 9/2019 |
| WO | WO 2019/190945 A1 | 10/2019 |
| WO | WO 2019/202510 A1 | 10/2019 |
| WO | WO 2019/209721 A1 | 10/2019 |
| WO | WO 2019/209885 A2 | 10/2019 |
| WO | WO 2019/210404 A1 | 11/2019 |
| WO | WO 2020/016287 A1 | 1/2020 |
| WO | WO 2020/023848 A1 | 1/2020 |
| WO | WO 2020/028722 A1 | 2/2020 |
| WO | WO 2020/051488 A1 | 3/2020 |
| WO | WO 2020/069142 A1 | 4/2020 |
| WO | WO 2020/069214 A2 | 4/2020 |
| WO | WO 2020/092823 A1 | 5/2020 |
| WO | WO 2020/102430 A1 | 5/2020 |
| WO | WO 2020/102541 A1 | 5/2020 |
| WO | WO 2020/112647 A1 | 6/2020 |
| WO | WO 2020/132181 A1 | 6/2020 |
| WO | WO 2020/141230 A1 | 7/2020 |
| WO | WO 2020/150233 A1 | 7/2020 |
| WO | WO 2020/160284 A1 | 8/2020 |
| WO | WO 2020/160289 A1 | 8/2020 |
| WO | WO 2020/161682 A1 | 8/2020 |
| WO | WO 2020/169221 A1 | 8/2020 |
| WO | WO 2020/176547 A1 | 9/2020 |
| WO | WO 2020/176998 A1 | 9/2020 |
| WO | WO 2020/190763 A1 | 9/2020 |
| WO | WO 2020/206427 A1 | 10/2020 |
| WO | WO 2020/208411 A1 | 10/2020 |
| WO | WO 2020/210810 A1 | 10/2020 |
| WO | WO 2020/214951 A1 | 10/2020 |
| WO | WO 2020/225820 A1 | 11/2020 |
| WO | WO 2020/232553 A1 | 11/2020 |
| WO | WO 2020/236789 A1 | 11/2020 |
| WO | WO 2020/247741 A1 | 12/2020 |
| WO | WO 2021/034847 A1 | 2/2021 |
| WO | WO 2021/034848 A1 | 2/2021 |
| WO | WO 2021/035359 A1 | 3/2021 |
| WO | WO 2021/042057 A1 | 3/2021 |
| WO | WO 2021/046367 A2 | 3/2021 |
| WO | WO 2021/055597 A1 | 3/2021 |
| WO | WO 2021/063396 A1 | 4/2021 |
| WO | WO 2021/067748 A1 | 4/2021 |
| WO | WO 2021/081246 A1 | 4/2021 |
| WO | WO 2021/081647 A1 | 5/2021 |
| WO | WO 2021/081648 A1 | 5/2021 |
| WO | WO 2021/092689 A1 | 5/2021 |
| WO | WO 2021/108617 A1 | 6/2021 |
| WO | WO 2021/150636 A1 | 7/2021 |

OTHER PUBLICATIONS

[No Author Listed], Bibenzyl synthase [Cymbidium hybrid cultivar], GenBank Accession No. AIM58716.1. Sep. 14, 2014. Accessible at: www.ncbi.nlm.nih.gov/protein/aim58716.1. 2 pages.

Preisig-Muller et al., The inducible 9, 10-dihydrophenanthrene pathway: characterization and expression of bibenzyl synthase and S-adenosylhomocysteine hydrolase. Arch Biochem Biophys. Feb. 20, 1995;317(1):201-207. doi: 10.1006/abbi.1995.1154.

Tan et al., Synthetic Pathway for the Production of Olivetolic Acid in *Escherichia coli*. ACS Synth Biol. Aug. 17, 2018;7(8):1886-1896. doi: 10.1021/acssynbio.8b00075. Epub Jul. 17, 2018.

Wrenbeck et al., An Automated Data-Driven Pipeline for Improving Heterologous Enzyme Expression. ACS Synth Biol. Mar. 15, 2019;8(3):474-481. doi: 10.1021/acssynbio.8b00486. Epub Feb. 8, 2019.

Degenhardt et al., Chapter 2—The Biosynthesis of Cannabinoids. From The Handbook of Cannabis and Related Pathologies. Ed Preedy. Academic Press. 2017. pp. 13-23. doi: 10.1016/B978-0-12-800756-3.00002-8. Accessible at https://www.sciencedirect.com/book/9780128007563/handbook-of-cannabis-and-related-pathologies.

Taura et al., A Novel Class of Plant Type III Polyketide Synthase Involved in Orsellinic Acid Biosynthesis from *Rhododendron dauricum*. Front Plant Sci. Sep. 27, 2016;7:1452. doi: 10.3389/fpls.2016.01452.

Taura et al., Cannabinerolic acid, a cannabinoid from *Cannabis sativa*. Phytochemistry. May 1995;39(2):457-458. doi: 10.1016/0031-9422(94)00887-Y.

Taura et al., Phytocannabinoids in *Cannabis sativa*: Recent Studies on Biosynthetic Enzymes. Chemistry & Biodiversity. Aug. 2007;4(8):1649-1663. doi: 10.1002/cbdv.200790145.

[No Author Listed], 2,4,6-trihydroxybenzophenone synthase. UniProt No. Q8SAS8. Jun. 1, 2002. Accessible at https://www.uniprot.org/uniprot/Q8SAS8. 7 pages.

[No Author Listed], 3,5,7-trioxododecanoyl-CoA synthase. UniProt No. B1Q2B6. May 20, 2008. Accessible at https://www.uniprot.org/uniprot/B1Q2B6. 7 pages.

[No Author Listed], 5,7-dihydroxy-2-methylchromone synthase. UniProt No. Q58VP7. Apr. 26, 2005. Accessible at https://www.uniprot.org/uniprot/Q58VP7. 7 pages.

(56) References Cited

OTHER PUBLICATIONS

[No Author Listed], ABBA prenyltransferase Ptf_St [Streptomyces tendae]. GenBank Accession No. AFS18550. Sep. 24, 2012. Accessible at https://www.ncbi.nlm.nih.gov/protein/AFS18550.1/. 2 pages.

[No Author Listed], acetyl-CoA carboxyltransferase subunit alpha [*Escherichia coli* str. K-12 substr. MG1655]. GenBank Accession No. NP_414727.1. Oct. 11, 2018. Accessible at https://www.ncbi.nlm.nih.gov/protein/NP_414727.1. 3 pages.

[No Author Listed], acetyl-CoA carboxyltransferase subunit beta [*Escherichia coli* str. K-12 substr. MG1655]. GenBank Accession No. NP_416819.1. Oct. 11, 2018. Accessible at https://www.ncbi.nlm.nih.gov/protein/NP_416819.1. 3 pages.

[No Author Listed], Acetyl-CoA synthetase, putative. UniProt No. B9RE68. Mar. 24, 2009. Accessible at https://www.uniprot.org/uniprot/B9RE68. 5 pages.

[No Author Listed], acyl-activating enzym 1 [Cannabis sativa]. GenBank Accession No. AFD33345.1. Aug. 1, 2012. Accessible at https://www.ncbi.nlm.nih.gov/protein/afd33345.1. 2 pages.

[No Author Listed], Aldehyde dehydrogenase. UniProt No. Q6C5T1. Aug. 16, 2004. Accessible at https://www.uniprot.org/uniprot/Q6C5T1. 5 pages.

[No Author Listed], Aspartic proteinase 3. UniProt No. P32329. Oct. 1, 1993. Accessible at https://www.uniprot.org/uniprot/P32329. 11 pages.

[No Author Listed], bibenzyl synthase [Phalaenopsis hybrid cultivar]. GenBank Accession No. CAA56277. Apr. 18, 2005. Accessible at https://www.ncbi.nlm.nih.gov/protein/CAA56277, 2 pages.

[No Author Listed], Bibenzyl synthase. UniProt No. A0A088G5Z5. Nov. 26, 2014. Accessible at https://www.uniprot.org/uniprot/A0A088G5Z5. 4 pages.

[No Author Listed], biotin carboxyl carrier protein [*Escherichia coli* str. K-12 substr. MG1655]. GenBank Accession No. NP_417721.1. Oct. 11, 2018. Accessible at https://www.ncbi.nlm.nih.gov/protein/NP_417721.1. 3 pages.

[No Author Listed], biotin carboxylase [*Escherichia coli* str. K-12 substr. MG1655]. GenBank Accession No. NP_417722.1 . Oct. 11, 2018. Accessible at https://www.ncbi.nlm.nih.gov/protein/NP_417722.1. 3 pages.

[No Author Listed], BnaA02g30320D protein. UniProt No. A0A078IM49. Oct. 29, 2014. Accessible at https://www.uniprot.org/uniprot/A0A078IM49. 5 pages.

[No Author Listed], cannabidiolic acid synthase [Cannabis sativa]. GenBank Accession No. BAF65033. Jun. 29, 2007. Accessible at https://www.ncbi.nlm.nih.gov/protein/BAF6503. 2pages.

[No Author Listed], cannabidiolic acid synthase [Cannabis sativa]. NCBI Reference Sequece No. XP_030480746.1. May 18, 2020. Accessible at https://www.ncbi.nlm.nih.gov/protein/xp_030480746. 2 pages.

[No Author Listed], Cannabidiolic acid synthase. UniProt No. A6P6V9. Aug. 21, 2007. Accessible at https://www.uniprot.org/uniprot/A6P6V9. 8 pages.

[No Author Listed], Cannabis sativa isolate 08 tetrahydrocannabinolic acid synthase gene, partial cds. GenBank Accession No. JQ437488. Oct. 24, 2013. Accessible at https://www.ncbi.nlm.nih.gov/nuccore/JQ437488. 2 pages.

[No Author Listed], Cannabis sativa OLS mRNA for olivetol synthase, complete cds. GenBank Accession No. AB164375.1. Jun. 20, 2009. Accessible at https://www.ncbi.nlm.nih.gov/nuccore/AB164375.1/. 2 pages.

[No Author Listed], Chalcone synthase 1. UniProt No. Q9SML4. May 1, 2000. Accessible at https://www.uniprot.org/uniprot/Q9SML4. 5 pages.

[No Author Listed], chalcone synthase 2 [Durio zibethinus]. NCBI Reference Sequence No. XP_022750423.1. Oct. 25, 2017. 2 pages. Retrieved from https://www.ncbi.nlm.nih.gov/protein/1269879603.

[No Author Listed], Chalcone synthase 2. UniProt No. Q9XJ57. Nov. 1, 1999. Accessible at https://www.uniprot.org/uniprot/Q9XJ57. 6 pages.

[No Author Listed], Chalcone synthase 8. UniProt No. Q8VWQ7. Mar. 1, 2002. Accessible at https://www.uniprot.org/uniprot/Q8VWQ7. 5 pages.

[No Author Listed], Chalcone synthase E. UniProt No. O22046. Jan. 1, 1998. Accessible at https://www.uniprot.org/uniprot/O22046. 5 pages.

[No Author Listed], Chalcone synthase. UniProt No. A0A022RTH3. Jun. 11, 2014. Accessible at https://www.uniprot.org/uniprot/A0A022RTH3. 5 pages.

[No Author Listed], Chalcone synthase. UniProt No. A0A059VFD5. Sep. 3, 2014. Accessible at https://www.uniprot.org/uniprot/A0A059VFD5. 5 pages.

[No Author Listed], Chalcone synthase. UniProt No. A0A0A6Z8B1. Mar. 4, 2015. Accessible at https://www.uniprot.org/uniprot/A0A0A6Z8B1. 4 pages.

[No Author Listed], Chalcone synthase. UniProt No. A0A0V0H4K5. Mar. 16, 2016. Accessible at https://www.uniprot.org/uniprot/A0A0V0H4K5. 4 pages.

[No Author Listed], Chalcone synthase. UniProt No. A0A1S4ATN2. Apr. 12, 2017. Accessible at https://www.uniprot.org/uniprot/A0A1S4ATN2. 5 pages.

[No Author Listed], Chalcone synthase. UniProt No. A0A1U7Z9S2. May 10, 2017. Accessible at https://www.uniprot.org/uniprot/A0A1U7Z9S2. 5 pages.

[No Author Listed], Chalcone synthase. UniProt No. A0A2K3P0B5. Mar. 28, 2018. Accessible at https://www.uniprot.org/uniprot/A0A2K3P0B5. 5 pages.

[No Author Listed], Chalcone synthase. UniProt No. B1N7F0. Apr. 29, 2008. Accessible at https://www.uniprot.org/uniprot/B1N7F0. 4 pages.

[No Author Listed], Chalcone synthase. UniProt No. G7IQL2. Jan. 25, 2012. Accessible at https://www.uniprot.org/uniprot/G7IQL2. 5 pages.

[No Author Listed], Chalcone synthase. UniProt No. I6R2S0. Oct. 3, 2012. Accessible at https://www.uniprot.org/uniprot/I6R2S0. 5 pages.

[No Author Listed], Chalcone synthase. UniProt No. P13114. Jan. 1, 1990. Accessible at https://www.uniprot.org/uniprot/P13114. 10 pages.

[No Author Listed], Chalcone synthase. UniProt No. Q1G6T7. Jun. 27, 2006. Accessible at https://www.uniprot.org/uniprot/Q1G6T7. 4 pages.

[No Author Listed], Chalcone synthase. UniProt No. Q2EFK0. Mar. 21, 2006. Accessible at https://www.uniprot.org/uniprot/Q2EFK0. 4 pages.

[No Author Listed], Chalcone synthase. UniProt No. Q2ENA5. Mar. 21, 2006. Accessible at https://www.uniprot.org/uniprot/Q2ENA5. 4 pages.

[No Author Listed], Chalcone synthase. Uniprot No. Q45RS8. Sep. 13, 2005. Accessible at https://www.uniprot.org/uniprot/Q45RS8. 4 pages.

[No Author Listed], Chalcone synthase. Uniprot No. Q45RT0. Sep. 13, 2005. Accessible at https://www.uniprot.org/uniprot/Q45RT0. 4 pages.

[No Author Listed], Chalcone synthase. UniProt No. Q6WJD6. Jul. 5, 2004. Accessible at https://www.uniprot.org/uniprot/Q6WJD6. 4 pages.

[No Author Listed], Chalcone synthase. UniProt No. Q9FR69. Mar. 1, 2001. Accessible at https://www.uniprot.org/uniprot/Q9FR69. 4 pages.

[No Author Listed], Chalcone synthase. UniProt No. Q9SEN0. May 1, 2000. Accessible at https://www.uniprot.org/uniprot/Q9SEN0. 4 pages.

[No Author Listed], Chalcone synthase. UniProt No. V7AZ15. Feb. 19, 2014. Accessible at https://www.uniprot.org/uniprot/V7AZ15. 5 pages.

[No Author Listed], Chalcone synthase. UniProt No. W0GAP3. Mar. 19, 2014. Accessible at https://www.uniprot.org/uniprot/W0GAP3. 4 pages.

[No Author Listed], Chalcone synthase. UniProt No. X5I326. Jun. 11, 2014. Accessible at https://www.uniprot.org/uniprot/X5I326. 4 pages.

(56) References Cited

OTHER PUBLICATIONS

[No Author Listed], Conium polyketide synthase 2. UniProt No. A0A0K0TQH0. Nov. 11, 2015. Accessible at https://www.uniprot.org/uniprot/A0A0K0TQH0. 4 pages.
[No Author Listed], Cymbidium hybrid cultivar bibenzyl synthase (BBS) mRNA, complete cds. GenBank Accession No. KM186175. Sep. 14, 2014. Accessible at https://www.ncbi.nlm.nih.gov/nuccore/km186175. 2 pages.
[No Author Listed], FAD-binding PCMH-type domain-containing protein. UniProt No. V7CQ62. Feb. 19, 2014. Accessible at https://www.uniprot.org/uniprot/V7CQ62. 5 pages.
[No Author Listed], hypothetical protein AQJ23_40425 [Streptomyces antibioticus]. GenBank Accession No. KUN17719.1. Jan. 13, 2016. Accessible at https://www.ncbi.nlm.nih.gov/protein/KUN17719.1. 2 pages.
[No Author Listed], hypothetical protein F8388_012843 [Cannabis sativa]. GenBank Accession No. KAF4364383.1. Apr. 28, 2020. Accessible at https://www.ncbi.nlm.nih.gov/protein/kaf4361383. 2 pages.
[No Author Listed], hypothetical protein FG87_05220 [Nocardia vulneris]. GenBank Accession No. KIA65866. Dec. 29, 2014. Accessible at https://www.ncbi.nlm.nih.gov/protein/KIA65866.1?report=genbank&log$=prottop&blast_rank=1&RID=VG9735AS013. 2 pages.
[No Author Listed], Mating factor alpha. UniProt No. U3N2M0. Dec. 11, 2013. Accessible at https://www.uniprot.org/uniprot/U3N2M0. 6 pages.
[No Author Listed], Naringenin-chalcone synthase. UniProt No. A0A1Q9SCX4. Apr. 12, 2017. Accessible at https://www.uniprot.org/uniprot/A0A1Q9SCX4. 4 pages.
[No Author Listed], Naringenin-chalcone synthase. UniProt No. Q8RVK9. Jun. 1, 2002. Accessible at https://www.uniprot.org/uniprot/Q8RVK9. 5 pages.
[No Author Listed], Olivetolic acid cyclase. UniProt No. I6WU39. Oct. 3, 2012. Accessible at https://www.uniprot.org/uniprot/I6WU39. 7 pages.
[No Author Listed], olivetolic acid cyclase [Cannabis sativa]. GenBank Accession No. XP_030508788.1. May 18, 2020. Accessible at https://www.ncbi.nlm.nih.gov/protein/XP_030508788.1. 1 page.
[No Author Listed], Pinosylvin synthase 2. UniProt No. P48408. Feb. 1, 1996. Accessible at https://www.uniprot.org/uniprot/P48408. 6 pages.
[No Author Listed], Polyketide synthase 3. UniProt No. F1LKH5. May 3, 2011. Accessible at https://www.uniprot.org/uniprot/F1LKH5. 5 pages.
[No Author Listed], polyketide synthase 4 [Cannabis sativa]. NCBI Reference Sequence XP_030482489.1. Aug. 28, 2019. Accessible at https://www.ncbi.nlm.nih.gov/protein/1731741778?sat=48&satkey=81326590. 2 pages.
[No Author Listed], Polyketide synthase 4. UniProt No. F1LKH8. May 3, 2011. Accessible at https://www.uniprot.org/uniprot/F1LKH8. 5 pages.
[No Author Listed], polyketide synthase 4-like [Cannabis sativa]. NCBI Reference Sequence XP_030482489.1. Aug. 28, 2019. Accessible at https://www.ncbi.nlm.nih.gov/protein/XP_030482489.1. 1 page.
[No Author Listed], Predicted: Camellia sinensis probable acyl-activating enzyme 17, peroxisomal (LOC114283428), mRNA. GenBank Accession No. XM_028226239.1. Mar. 5, 2019. Accessible at https://www.ncbi.nlm.nih.gov/nuccore/XM_028226239.1. 3 pages.
[No Author Listed], prenyltransferase [Streptomyces sp.]. GenBank Accession No. AWW43729. Jun. 20, 2018. Accessible at https://www.ncbi.nlm.nih.gov/protein/aww43729. 2 pages.
[No Author Listed], Prenyltransferase 1. Uniprot No. A0A4557IK6. Jun. 5, 2019. Accessible at https://www.uniprot.org/uniprot/A0A455ZIK6. 4 pages.
[No Author Listed], Prenyltransferase 4. Uniprot No. A0A455ZJC3. Jun. 5, 2019. Accessible at https://www.uniprot.org/uniprot/A0A455ZJC3. 4 pages.
[No Author Listed], Prenyltransferase. UniProt No. Q4R2T2. Jul. 19, 2005. Accessible at https://www.uniprot.org/uniprot/Q4R2T2. 5 pages.
[No Author Listed], probable acyl-activating enzyme 17, peroxisomal [Cicer arietinum]. GenBank Accession No. XP_00448 8 348.1. Dec. 14, 2018. Accessible at https://www.ncbi.nlm.nih.gov/protein/XP_004488348.1. 2 pages.
[No Author Listed], Probable acyl-activating enzyme 17, peroxisomal. UniProt No. A0A1S2XHV8. Apr. 12, 2017. Accessible at https://www.uniprot.org/uniprot/A0A1S2XHV8. 5 pages.
[No Author Listed], Putative acyl-CoA ligase. UniProt No. Q6N948. Jul. 5, 2004. Accessible at https://www.uniprot.org/uniprot/Q6N948. 5 pages.
[No Author Listed], Putative long-chain-fatty-acid CoA ligase. UniProt No. Q6N4N8. Jul. 5, 2004. Accessible at https://www.uniprot.org/uniprot/Q6N4N8. 5 pages.
[No Author Listed], Putative thiolase-like protein. UniProt No. A0A251SHA8. Nov. 22, 2017. Accessible at https://www.uniprot.org/uniprot/A0A251SHA8. 5 pages.
[No Author Listed], Resveratrol synthase. UniProt No. I3QQ50. Sep. 5, 2012. Accessible at https://www.uniprot.org/uniprot/I3QQ50. 4 pages.
[No Author Listed], Stilbene synthase 1. UniProt No. A0A0K8QHJ1. Nov. 11, 2015. Accessible at https://www.uniprot.org/uniprot/A0A0K8QHJ1. 4 pages.
[No Author Listed], Stilbene synthase STS1b. UniProt No. A0A140KXU1. May 11, 2016. Accessible at https://www.uniprot.org/uniprot/A0A140KXU1. 4 pages.
[No Author Listed], Stilbene synthase. UniProt No. A0A2T7T652. Jul. 18, 2018. Accessible at https://www.uniprot.org/uniprot/A0A2T7T652. 4 pages.
[No Author Listed], Stilbene synthase. UniProt No. G5CU92. Dec. 14, 2011. Accessible at https://www.uniprot.org/uniprot/G5CU92. 4 pages.
[No Author Listed], Stilbene synthase. UniProt No. G5CUA2. Dec. 14, 2011. Accessible at https://www.uniprot.org/uniprot/G5CUA2. 4 pages.
[No Author Listed], Stilbene synthase. UniProt No. I6RBH2. Oct. 3, 2012. Accessible at https://www.uniprot.org/uniprot/I6RBH2. 5 pages.
[No Author Listed], Stilbene synthase. UniProt No. I6S977. Oct. 3, 2012. Accessible at https://www.uniprot.org/uniprot/I6S977. 5 pages.
[No Author Listed], Stilbene synthase. UniProt No. I6VW29. Oct. 3, 2012. Accessible at https://www.uniprot.org/uniprot/I6VW29. 5 pages.
[No Author Listed], Stilbene synthase. UniProt No. I6VW41. Oct. 3, 2012. Accessible at https://www.uniprot.org/uniprot/I6VW41. 5 pages.
[No Author Listed], Stilbene synthase. UniProt No. I6W888. Oct. 3, 2012. Accessible at https://www.uniprot.org/uniprot/I6W888. 4 pages.
[No Author Listed], Stilbene synthase. UniProt No. K7XD27. Feb. 6, 2013. Accessible at https://www.uniprot.org/uniprot/K7XD27. 4 pages.
[No Author Listed], Stilbenecarboxylate synthase. UniProt No. Q8GZP4. Mar. 1, 2003. Accessible at https://www.uniprot.org/uniprot/Q8GZP4. 4 pages.
[No Author Listed], Terpene synthase family, metal binding domain protein. UniProt No. A0A254UC34. Nov. 22, 2017. Accessible at https://www.uniprot.org/uniprot/A0A254UC34. 4 pages.
[No Author Listed], tetrahydrocannabinolic acid synthase [Cannabis sativa]. GenBank Accession No. AJB28532.1. Jul. 23, 2015. Accessible at https://www.ncbi.nlm.nih.gov/protein/ajb28532. 2 pages.
[No Author Listed], Tetrahydrocannabinolic acid synthase gene. GenBank Accession No. E33090. Nov. 5, 2005. Accessible at https://www.ncbi.nlm.nih.gov/nuccore/e33090. 2 pages.
[No Author Listed], tetrahydrocannabinolic acid synthase precursor [Cannabis sativa]. GenBank Accession No. BAC41356. Sep. 15, 2004. Accessible at https://www.ncbi.nlm.nih.gov/protein/BAC41356. 2 pages.
[No Author Listed], tetrahydrocannabinolic acid synthase, partial [Cannabis sativa]. GenBank Accession No. AKC34402.1. Apr. 18, 2015. Accessible at https://www.ncbi.nlm.nih.gov/protein/AKC34402.1. 2 pages.

(56) References Cited

OTHER PUBLICATIONS

[No Author Listed], Tetrahydrocannabinolic acid synthase. Jul. 11, 2012 UniProt No. I1V0C5. Accessible at https://www.uniprot.org/uniprot/I1V0C5. 5 pages.
[No Author Listed], Tetrahydrocannabinolic acid synthase. UniProt No. Q8GTB6. Mar. 1, 2003. Accessible at https://www.uniprot.org/uniprot/Q8GTB6. 11 pages.
[No Author Listed], tetrahydrocannabinolic acid synthase, partial [Cannabis sativa]. GenBank Accession No. AFI24252.1. Oct. 24, 2013. Accessible at https://www.ncbi.nlm.nih.gov/protein/afi24252.1. 2 pages.
[No Author Listed], TPA_exp: Cannabis sativa prenyltransferase 4 (PT4) mRNA, complete cds. GenBank Accession No. BK010648. Mar. 29, 2019. Accessible at https://www.ncbi.nlm.nih.gov/nuccore/bk010648. 2 pages.
[No Author Listed], TPA_exp: prenyltransferase 4 [Cannabis sativa]. GenBank Accession No. DAC76710.1. Mar. 29, 2019. Accessible at https://www.ncbi.nlm.nih.gov/protein/DAC76710.1. 2 pages.
[No Author Listed], TSA: Cannabis sativa PK15523.1_1.CasaPuKu mRNA sequence. GenBank Accession No. JP460119.1. Oct. 28, 2011. Accessible at https://www.ncbi.nlm.nih.gov/nuccore/JP460119. 2 pages.
[No Author Listed], Ubiquitin-conjugating enzyme E2 6. UniProt No. P33296. Feb. 1, 1994. Accessible at https://www.uniprot.org/uniprot/P33296. 9 pages.
[No Author Listed], Uncharacterized protein. Uniprot No. A0A0C3GMG8. Apr. 1, 2015. Accessible at https://www.uniprot.org/uniprot/A0A0C3GMG8. 4 pages.
[No Author Listed], Uncharacterized protein. UniProt No. A0A0D6QTX3. May 27, 2015. Accessible at https://www.uniprot.org/uniprot/A0A0D6QTX3. 4 pages.
[No Author Listed], Uncharacterized protein. UniProt No. A0A0D6QW95. May 27, 2015. Accessible at https://www.uniprot.org/uniprot/A0A0D6QW95. 4 pages.
[No Author Listed], Uncharacterized protein. Uniprot No. A0A132B7I1. May 11, 2016. Accessible at https://www.uniprot.org/uniprot/A0A132B7I1. 4 pages.
[No Author Listed], Uncharacterized protein. UniProt No. A0A164ZDA1. Jul. 6, 2016. Accessible at https://www.uniprot.org/uniprot/A0A164ZDA1. 5 pages.
[No Author Listed], Uncharacterized protein. Uniprot No. A0A1R3GC47. Apr. 12, 2017. Accessible at https://www.uniprot.org/uniprot/A0A1R3GC47. 5 pages.
[No Author Listed], Uncharacterized protein. UniProt No. A0A1R3HSU5. Apr. 12, 2017. Accessible at https://www.uniprot.org/uniprot/A0A1R3HSU5. 4 pages.
[No Author Listed], Uncharacterized protein. UniProt No. A0A2G5F4L7. Jan. 31, 2018. Accessible at https://www.uniprot.org/uniprot/A0A2G5F4L7. 4 pages.
[No Author Listed], Uncharacterized protein. UniProt No. A2EFK0. Feb. 20, 2007. Accessible at https://www.uniprot.org/uniprot/A2EFK0. 3 pages.
[No Author Listed], Uncharacterized protein. UniProt No. F6HP23. Jul. 27, 2011. Accessible at https://www.uniprot.org/uniprot/F6HP23. 6 pages.
[No Author Listed], Uncharacterized protein. UniProt No. K3Y7T4. Nov. 28, 2012. Accessible at https://www.uniprot.org/uniprot/K3Y7T4. 4 pages.
[No Author Listed], Uncharacterized protein. UniProt No. M4DVZ4. May 1, 2013. Accessible at https://www.uniprot.org/uniprot/M4DVZ4. 5 pages.
[No Author Listed], UniProt No. A0A2T5VUN1. Jul. 18, 2018. Accessible at https://www.uniprot.org/uniprot/A0A2T5VUN1. 1 page.
[No Author Listed], Wt3.9 [Streptomyces sp. WT3]. GenBank Accession No. AFI64508. May 5, 2012. Accessible at https://www.ncbi.nlm.nih.gov/protein/afi64508. 1 page.
[No Author Listed], YALI0B07755p. UniProt No. Q6CFE4. Aug. 16, 2004. Accessible at https://www.uniprot.org/uniprot/Q6CFE4. 4 pages.
[No Author Listed], YALI0E12419p. UniProt No. Q6C650. Aug. 16, 2004. Accessible at https://www.uniprot.org/uniprot/Q6C650. 4 pages.
[No Author Listed], YALI0E20405p. UniProt No. Q6C577. Aug. 16, 2004. Accessible at https://www.uniprot.org/uniprot/Q6C577. 4 pages.
Altschul et al., Basic local alignment search tool. J Mol Biol. Oct. 5, 1990;215(3):403-10. doi: 10.1016/S0022-2836(05)80360-2.
Altschul et al., Gapped BLAST and PSI-BLAST: a new generation of protein database search programs. Nucleic Acids Res. Sep. 1, 1997;25(17):3389-402. doi: 10.1093/nar/25.17.3389.
Baba et al., Construction of *Escherichia coli* K-12 in-frame, single-gene knockout mutants: the Keio collection. Mol Syst Biol. 2006;2:2006-0008. doi: 10.1038/msb4100050. Epub Feb. 21, 2006.
Berman et al., A new ESI-LC/MS approach for comprehensive metabolic profiling of phytocannabinoids in Cannabis. Sci Rep. Sep. 24, 2018;8(1):14280. doi: 10.1038/s41598-018-32651-4.
Brake et al., Alpha-factor-directed synthesis and secretion of mature foreign proteins in *Saccharomyces cerevisiae*. Proc Natl Acad Sci U S A. Aug. 1984;81(15):4642-6. doi: 10.1073/pnas.81.15.4642.
Brenneisen, Chemistry and Analysis of Phytocannabinoids and Other Cannabis Constituents. In: ElSohly M.A. (eds) Marijuana and the Cannabinoids. Forensic Science And Medicine. Humana Press. 2007. https://doi.org/10.1007/978-1-59259-947-9_2.
Carvalho et al., Designing microorganisms for heterologous biosynthesis of cannabinoids. FEMS Yeast Res. Jun. 1, 2017;17(4):fox037. doi: 10.1093/femsyr/fox037.
Chatzivasileiou et al., Two-step pathway for isoprenoid synthesis. Proc Natl Acad Sci U S A. Jan. 8, 2019;116(2):506-511. doi: 10.1073/pnas.1812935116. Epub Dec. 24, 2018.
Chen et al., Molecular insights into the enzyme promiscuity of an aromatic prenyltransferase. Nat Chem Biol. Feb. 2017;13(2):226-234. doi: 10.1038/nchembio.2263. Epub Dec. 19, 2016.
Cheon et al., A biosynthetic pathway for hexanoic acid production in Kluyveromyces marxianus. J Biotechnol. Jul. 20, 2014;182-183:30-6. doi: 10.1016/j.jbiotec.2014.04.010. Epub Apr. 22, 2014.
Chojnacki et al., Programmatic access to bioinformatics tools from EMBL-EBI update: 2017. Nucleic Acids Res. Jul. 3, 2017;45(W1):W550-W553. doi: 10.1093/nar/gkx273.
Citti et al., A novel phytocannabinoid isolated from *Cannabis sativa* L. with an in vivo cannabimimetic activity higher than Δ9-tetrahydrocannabinol: Δ9-Tetrahydrocannabiphorol. Sci Rep. Dec. 30, 2019;9(1):20335. doi: 10.1038/s41598-019-56785-1.
Console-Bram et al., Activation of GPR18 by cannabinoid compounds: a tale of biased agonism. Br J Pharmacol. Aug. 2014;171(16):3908-17. doi: 10.1111/bph.12746.
Crandall, A Chronic Problem: Taming Energy Costs and Impacts from Marijuana Cultivation. EQ Research. Sep. 2016. 24 pages.
De Meijer et al., The inheritance of chemical phenotype in *Cannabis sativa* L. (II): Cannabigerol predominant plants. Euphytica. Sep. 2005;145:189-98.
De Meijer et al., The inheritance of chemical phenotype in *Cannabis sativa* L. (III): variation in cannabichromene proportion. Euphytica. Jan. 2009;165:293-311.
De Meijer et al., The inheritance of chemical phenotype in *Cannabis sativa* L. (IV): cannabinoid-free plants. Euphytica. Jan. 2009;168:95-112.
De Meijer et al., The inheritance of chemical phenotype in *Cannabis sativa* L. Genetics. Jan. 2003;163(1):335-46.
Degenhardt, Evaluation of C-prenylating enzymes for the heterologous biosynthesis of cannabigerolic acid. Dissertation. Technischen Universitat Dortmund. Orally presented Oct. 9, 2018. Dissertation Published on Feb. 1, 2019. 183 pages.
Dillis et al., Water storage and irrigation practices for cannabis drive seasonal patterns of water extraction and use in Northern California. J Environ Manage. Oct. 15, 2020;272:110955. doi: 10.1016/j.jenvman.2020.110955. Epub Jul. 13, 2020. 15 pages.
Dolgin, Scientists brew cannabis using hacked beer yeast. Nature News Article. Feb. 27, 2019. Retrieved from https://www.nature.com/articles/d41586-019-00714-9. 3 pages.
El Alaoui et al., Extraction of high quality DNA from seized Moroccan cannabis resin (Hashish). PLoS One. Oct. 4, 2013;8(10):e74714. doi: 10.1371/journal.pone.0074714.

(56) References Cited

OTHER PUBLICATIONS

El-Alfy et al., Antidepressant-like effect of delta9-tetrahydrocannabinol and other cannabinoids isolated from *Cannabis sativa* L. Pharmacol Biochem Behav. Jun. 2010;95(4):434-42. doi: 10.1016/j.pbb.2010.03.004. Epub Mar. 21, 2010.

Fellermeier et al., Prenylation of olivetolate by a hemp transferase yields cannabigerolic acid, the precursor of tetrahydrocannabinol. FEBS Lett. May 8, 1998;427(2):283-5. doi: 10.1016/s0014-5793(98)00450-5.

Flemming et al., Chemistry and Biological Activity of Tetrahydrocannabinol and its Derivatives. TopHeterocyl Chem. 2007;110:1-42.

Flores-Sanchez et al., Secondary Metabolism in Cannabis. Phytochemistry Rev. Apr. 8, 2008;7:615-39. do: 10.1007/s11101-008-9094-4.

Funa et al., Pentaketide resorcylic acid synthesis by type III polyketide synthase from Neurospora crassa. J Biol Chem. May 11, 2007;282(19):14476-81. doi: 10.1074/jbc.M701239200. Epub Mar. 20, 2007.

Gagne et al., Identification of olivetolic acid cyclase from Cannabis sativa reveals a unique catalytic route to plant polyketides. Proc Natl Acad Sci USA. Jul. 31, 2012;109(31):12811-6. doi: 10.1073/pnas.12003 30109. Epub Jul. 16, 2012.

Gardner et al., Manipulating the yeast genome: deletion, mutation, and tagging by PCR. Methods Mol Biol. 2014;1205:45-78. doi: 10.1007/978-1-4939-1363-3_5.

George et al., Metabolic engineering for the high-yield production of isoprenoid-based $C_5$ alcohols in *E. coli*. Sci Rep. Jun. 8, 2015;5:11128. doi: 10.1038/srep11128. 12 pages.

Gietz et al., Yeast transformation by the LiAc/SS Carrier DNA/PEG method. Methods Mol Biol. 2006;313:107-20. doi: 10.1385/1-59259-958-3:107.

Go et al., Cannabinoid biosynthesis using noncanonical cannabinoid synthases. bioRxiv. Jan. 31, 2020. doi: https://doi.org/10.1101/2020.01.29.926089.

Goldenzweig et al., Automated Structure- and Sequence-Based Design of Proteins for High Bacterial Expression and Stability. Mol Cell. Jul. 21, 2016;63(2):337-346. doi: 10.1016/j.molcel.2016.06.012. Epub Jul. 14, 2016. Erratum in: Mol Cell. Apr. 19, 2018;70(2):380.

Hanus et al., Phytocannabinoids: a unified critical inventory. Nat Prod Rep. Nov. 23, 2016;33(12):1357-1392. doi: 10.1039/c6np00074f.

Hochberg et al., Reconstructing Ancient Proteins to Understand the Causes of Structure and Function. Annu Rev Biophys. May 22, 2017;46:247-269. doi: 10.1146/annurev-biophys-070816-033631. Epub Mar. 15, 2017.

Ignea et al., Engineering monoterpene production in yeast using a synthetic dominant negative geranyl diphosphate synthase. ACS Synth Biol. May 16, 2014;3(5):298-306. doi: 10.1021/sb400115e. Epub Jan. 3, 2014.

Jourabchi et al., Electrical load impacts of indoor commercial cannabis production. Northwest Power and Conservation Council. Sep. 3, 2014. 12 pages.

Kabiri et al., A stimulus-responsive, in situ-forming, nanoparticle-laden hydrogel for ocular drug delivery. Drug Deliv Transl Res. Jun. 2018;8(3):484-495. doi: 10.1007/s13346-018-0504-x.

Kabsch et al., Dictionary of protein secondary structure: pattern recognition of hydrogen-bonded and geometrical features. Biopolymers. Dec. 1983;22(12):2577-637. doi: 10.1002/bip.360221211.

Kampranis et al., Developing a yeast cell factory for the production of terpenoids. Comput Struct Biotechnol J. Nov. 5, 2012;3:e201210006(1-7). doi: 10.5936/csbj.201210006.

Karlin et al., Applications and statistics for multiple high-scoring segments in molecular sequences. Proc Natl Acad Sci USA. Jun. 15, 1993;90(12):5873-7. doi: 10.1073/pnas.90.12.5873.

Karlin et al., Methods for assessing the statistical significance of molecular sequence features by using general scoring schemes. Proc Natl Acad Sci USA. Mar. 1990;87(6):2264-8. doi: 10.1073/pnas.87.6.2264.

Krink-Koutsoubelis et al., Engineered Production of Short-Chain Acyl-Coenzyme A Esters in *Saccharomyces cerevisiae*. ACS Synth Biol. Apr. 20, 2018;7(4):1105-1115. doi: 10.1021/acssynbio.7b00466. Epub Mar. 12, 2018.

Kumano et al., Chemoenzymatic syntheses of prenylated aromatic small molecules using Streptomyces prenyltransferases with relaxed substrate specificities. Bioorg Med Chem. Sep. 1, 2008;16(17):8117-26. doi: 10.1016/j.bmc.2008.07.052. Epub Jul. 24, 2008.

Kunkel, Rapid and efficient site-specific mutagenesis without phenotypic selection. Proc Natl Acad Sci USA. Jan. 1985;82(2):488-92. doi: 10.1073/pnas.82.2.488.

Kuzuyama et al., Structural basis for the promiscuous biosynthetic prenylation of aromatic natural products. Nature. Jun. 16, 2005;435(7044):983-7. doi: 10.1038/nature03668.

Lange et al., Δ(9)-Tetrahydrocannabinohc acid synthase production in Pichia pastoris enables chemical synthesis of cannabinoids. J Biotechnol. Oct. 10, 2015;211:68-76. doi: 10.1016/j.jbiotec.2015.06.425. Epub Jul. 18, 2015.

Lund et al., An Artificial Pathway for Isoprenoid Biosynthesis Decoupled from Native Hemiterpene Metabolism. ACS Synth Biol. Feb. 15, 2019;8(2):232-238. doi: 10.1021/acssynbio.8b00383. Epub Jan. 16, 2019.

Luo et al., Complete biosynthesis of cannabinoids and their unnatural analogues in yeast. Nature. Mar. 2019;567(7746):123-126. doi: 10.1038/s41586-019-0978-9. Epub Feb. 27, 2019. Erratum in: Nature. Apr. 2020;580(7802):E2.

Lv et al., Enhanced isoprene biosynthesis in *Saccharomyces cerevisiae* by engineering of the native acetyl-CoA and mevalonic acid pathways with a push-pull-restrain strategy. J Biotechnol. Sep. 30, 2014;186:128-36. doi: 10.1016/j.jbiotec.2014.06.024. Epub Jul. 9, 2014.

Madhusoodanan, A greener grass: Can the environmental impact of cannabis cultivation be reduced?. Nature. Aug. 29, 2019;572:S8(1-2).

Mills, The carbon footprint of indoor Cannabis production. Energy Policy. Jul. 2012;46:58-67.

Morimoto et al., Enzymological Evidence for Cannabichromenic Acid Biosynthesis. J. Nat. Prod. 1997;60(8):854-857. doi: 10.1021/np970210y.

Morimoto et al., Purification and characterization of cannabichromenic acid synthase from Cannabis sativa. Phytochemistry. Nov. 1998;49(6):1525-9. doi: 10.1016/s0031-9422(98)00278-7.

Mukherjee et al., GPCR-Based Chemical Biosensors for Medium-Chain Fatty Acids. ACS Synth Biol. Dec. 18, 2015;4(12):1261-9. doi: 10.1021/sb500365m. Epub May 20, 2015.

Needleman et al., A general method applicable to the search for similarities in the amino acid sequence of two proteins. J Mol Biol. Mar. 1970;48(3):443-53. doi: 10.1016/0022-2836(70)90057-4.

O'Hare et al., Environmental risks and opportunities in cannabis cultivation. BOTEC Analysis Corp. Jun. 28, 2013. 31 pages.

Onofri et al., Sequence heterogeneity of cannabidiolic- and tetrahydrocannabinolic acid-synthase in *Cannabis sativa* L. and its relationship with chemical phenotype. Phytochemistry. Aug. 2015;116:57-68. doi: 10.1016/j.phytochem.2015.03.006. Epub Apr. 9, 2015.

O'Sullivan, An update on PPAR activation by cannabinoids. Br J Pharmacol. Jun. 2016;173(12):1899-910. doi: 10.1111/bph.13497. Epub May 19, 2016.

Pamplaniyil et al., Identification, isolation, and functional characterization of terpene transferases in Cannabis sativa. Presentation. Biotrends Conference, Dortmund, Germany. 2011. 1 page.

Pamplaniyil, Identification, isolation, and functional characterization of prenyltransferases in *Cannabis sativa* L. Dissertation. Technischen Universitat Dortmund. Orally presented Mar. 6, 2017. Dissertation Published on Jan. 17, 2018. 141 pages.

Pelham et al., Sorting of soluble ER proteins in yeast. EMBO J. Jun. 1988;7(6):1757-62.

Poussu et al., A gene truncation strategy generating N- and C-terminal deletion variants of proteins for functional studies: mapping of the Sec1p binding domain in yeast Mso1p by a Mu in vitro transposition-based approach. Nucleic Acids Res. Jul. 8, 2005;33(12):e104. doi: 10.1093/nar/gni102.

(56) References Cited

OTHER PUBLICATIONS

Ratledge et al., Regulation of lipid accumulation in oleaginous micro-organisms. Biochem Soc Trans. Nov. 2002;30(Pt 6):1047-50. doi: 10.1042/bst0301047.
Saleh et al., Activation of a silent phenazine biosynthetic gene cluster reveals a novel natural product and a new resistance mechanism against phenazines. Med Chem Commun. Apr. 4, 2012;3:1009-19. DOI: 10.1039/C2MD20045G.
Sanders et al., Yeast produce low-cost, high-quality cannabinoids. Science Daily. Feb. 27, 2019. Retrieved from https://www.sciencedaily.com/releases/2019/02/190227131838.htm. 4 pages.
Shams Yazdani et al., Engineering *Escherichia coli* for the efficient conversion of glycerol to ethanol and co-products. Metab Eng. Nov. 2008;10(6):340-51. doi: 10.1016/j.ymben.2008.08.005. Epub Sep. 9, 2008.
Shaw et al., Engineering a Model Cell for Rational Tuning of GPCR Signaling. Cell. Apr. 18, 2019;177(3):782-796.e27. doi: 10.1016/j.cell.2019.02.023. Epub Apr. 4, 2019.
Shi et al., The novel cannabinoid receptor GPR55 mediates anxiolytic-like effects in the medial orbital cortex of mice with acute stress. Mol Brain. Aug. 11, 2017;10(1):38. doi: 10.1186/s13041-017-0318-7.
Shoyama et al., Structure and function of Δ1-tetrahydrocannabinolic acid (THCA) synthase, the enzyme controlling the psychoactivity of Cannabis sativa. J Mol Biol. Oct. 12, 2012;423(1);96-105. doi: 10.1016/j.jmb.2012.06.030. Epub Jul. 2, 2012.
Sievers et al., Fast, scalable generation of high-quality protein multiple sequence alignments using Clustal Omega. Mol Syst Biol. Oct. 11, 2011;7:539. doi: 10.1038/msb.2011.75.
Singh et al., *Saccharomyces cerevisiae* contains two discrete genes coding for the alpha-factor pheromone. Nucleic Acids Res. Jun. 25, 1983;11(12):4049-63. doi: 10.1093/nar/11.12.4049.
Sirikantaramas et al., Tetrahydrocannabinolic acid synthase, the enzyme controlling marijuana psychoactivity, is secreted into the storage cavity of the glandular trichomes. Plant Cell Physiol. Sep. 2005;46(9):1578-82. doi: 10.1093/pcp/pci166. Epub Jul. 15, 2005.
Sirikantaramas et al., The gene controlling marijuana psychoactivity: molecular cloning and heterologous expression of Delta1-tetrahydrocannabinolic acid synthase from *Cannabis sativa* L. J Biol Chem. Sep. 17, 2004;279(38):39767-74. doi: 10.1074/jbc.M403693200. Epub Jun. 9, 2004.
Sirikantarams et al., Recent advances in Cannabis sativa research: biosynthetic studies and its potential in biotechnology. Curr Pharm Biotechnol. Aug. 2007;8(4):237-43. doi: 10.2174/138920107781387456.
Smith et al., Identification of common molecular subsequences. J Mol Biol. Mar. 25, 1981;147(1):195-7. doi: 10.1016/0022-2836(81)90087-5.
Song, Comparing cannabis cultivation energy consumption. New Frontier data. Oct. 14, 2018. 1 page. Retrieved from https://newfrontierdata.com/cannabis-insights/comparing-cannabis-cultivation-energy-consumption/.
Sonnhammer et al., Pfam: a comprehensive database of protein domain families based on seed alignments. Proteins. Jul. 1997;28(3):405-20. doi: 10.1002/(sici)1097-0134(Jul. 1997)28:3<405::aid-prot10>3.0.co;2-1.
Staginnus et al., A PCR marker linked to a THCA synthase polymorphism is a reliable tool to discriminate potentially THC-rich plants of *Cannabis sativa* L. J Forensic Sci. Jul. 2014;59(4):919-26. doi: 10.1111/1556-4029.12448. Epub Mar. 3, 2014.
Stormo et al., Use of the 'Perceptron' algorithm to distinguish translational initiation sites in *E. coli*. Nucleic Acids Res. May 11, 1982;10(9):2997-3011. doi: 10.1093/nar/10.9.2997.
Stout et al., The hexanoyl-CoA precursor for cannabinoid biosynthesis is formed by an acyl-activating enzyme in Cannabis sativa trichomes. Plant J. Aug. 2012;71(3):353-65. doi: 10.1111/j.1365-313X.2012.04949.x. Epub Jun. 1, 2012.
Taura et al., Cannabidiolic-acid synthase, the chemotype-determining enzyme in the fibertype Cannabis sativa. FEBS Lett. Jun. 26, 2007;581(16):2929-34. doi: 10.1016/j.febslet.2007.05.043. Epub May 25, 2007.
Taura et al., Characterization of olivetol synthase, a polyketide synthase putatively involved in cannabinoid biosynthetic pathway. FEBS Lett. Jun. 18, 2009;583(12):2061-6. doi: 10.1016/j.febslet.2009.05.024. Epub May 19, 2009.
Taura et al., First direct evidence for the mechanism of $\Delta^1$-tetrahydrocannabinolic acid biosynthesis. J Am Chem Soc. Sep. 1, 1995;117(38):9766-7.
Taura et al., Production of $\Delta^1$-tetrahydrocannabinolic acid by the biosynthetic enzyme secreted from transgenic Pichia pastoris. Biochem Biophys Res Commun. Sep. 28, 2007;361(3):675-80. doi: 10.1016/j.bbrc.2007.07.079. Epub Jul. 24, 2007.
Taura et al., Purification and characterization of cannabidiolic-acid synthase from *Cannabis sativa* L.. Biochemical analysis of a novel enzyme that catalyzes the oxidocyclization of cannabigerolic acid to cannabidiolic acid. J Biol Chem. Jul. 19, 1996;271(29):17411-6. doi: 10.1074/jbc.271.29.17411.
Touw et al., A series of PDB-related databanks for everyday needs. Nucleic Acids Res. Jan. 2015;43(Database issue):D364-8. doi: 10.1093/nar/gku1028. Epub Oct. 28, 2014.
Valliere et al., A cell-free platform for the prenylation of natural products and application to cannabinoid production. Nat Commun. Feb. 4, 2019;10(1):565(1-9). doi: 10.1038/s41467-019-08448-y. Erratum in: Nat Commun. May 24, 2019;10(1):2363.
Van Bakel et al., The draft genome and transcriptome of Cannabis sativa. Genome Biol. Oct. 20, 2011;12(10):R102. doi: 10.1186/GB-2011-12-10-r102. 18 pages.
Wagner et al., Consequences of membrane protein overexpression in *Escherichia coli*. Mol Cell Proteomics. Sep. 2007;6(9):1527-50. doi: 10.1074/mcp.M600431-MCP200. Epub Apr. 19, 2007.
Wang et al., Decarboxylation Study of Acidic Cannabinoids: A Novel Approach Using Ultra-High-Performance Supercritical Fluid Chromatography/Photodiode Array-Mass Spectrometry. Cannabis Cannabinoid Res. Dec. 1, 2016;1(1):262-271. doi: 10.1089/can.2016.0020.
Weiner et al., Rapid motif-based prediction of circular permutations in multi-domain proteins. Bioinformatics. Apr. 1, 2005;21(7):932-7. doi: 10.1093/bioinformatics/bti085.
Westfall et al., Production of amorphadiene in yeast, and its conversion to dihydroartemisinic acid, precursor to the antimalarial agent artemisinin. Proc Natl Acad Sci U S A. Jan. 17, 2012;109(3):E111-8. doi: 10.1073/pnas.1110740109. Epub Jan. 12, 2012.
Wrenbeck et al., Plasmid-based one-pot saturation mutagenesis. Nat Methods. Nov. 2016;13(11):928-930. doi: 10.1038/nmeth.4029. Epub Oct. 10, 2016.
Yang et al., Structural basis for olivetolic acid formation by a polyketide cyclase from Cannabis sativa. FEBS J. Mar. 2016;283(6):1088-106. doi: 10.1111/febs.13654. Epub Feb. 2, 2016.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Zhang et al., Engineering yeast metabolism for production of terpenoids for use as perfume ingredients, pharmaceuticals and biofuels. FEMS Yeast Res. Dec. 1, 2017;17(8):1-11. doi: 10.1093/femsyr/fox080.
Zhao et al., Improving monoterpene geraniol production through geranyl diphosphate synthesis regulation in *Saccharomyces cerevisiae*. Appl Microbiol Biotechnol. May 2016;100(10):4561-71. doi: 10.1007/s00253-016-7375-1. Epub Feb. 5, 2016.
Zirpel et al., Optimization of Δ9-tetrahydrocannabinolic acid synthase production in Komagataella phaffii via post-translational bottleneck identification. J Biotechnol. Apr. 2, 20180;272-273:40-47. doi: 10.1016/j.jbiotec.2018.03.008. Epub Mar. 13, 2018.
Zirpel et al., Production of Δ9-tetrahydrocannabinolic acid from cannabigerolic acid by whole cells of Pichia (Komagataella) pastoris expressing Δ9-tetrahydrocannabinolic acid synthase from *Cannabis sativa* L. Biotechnol Lett. Sep. 2015;37(9):1869-75. doi: 10.1007/s10529-015-1853-x. Epub May 21, 2015.
Zirpel, Recombinant Expression and Functional Characterization of Cannabinoid Producing Enzymes in Komagataella phaffi. Dissertation. Technischen Universitat Dortmund. Orally Presented May 2, 2018. Dissertation Published on Aug. 10, 2018. 182 pages.
PCT/US2020/019760, May 29, 2020, International Search Report and Written Opinion.

(56) References Cited

OTHER PUBLICATIONS

[No Author Listed], Coumaroyl triacetic acid synthase. UniProt No. O82145. Integrated into UniProt on Nov. 1, 1998; Entry last modified on Feb. 10, 2021; Accessible at https://www.uniprot.org/uniprot/O82145. 4 pages.

[No Author Listed], Cronos Group and Ginkgo Bioworks Amend Agreement to Accelerate Commercialization of Cultured Cannabinoids and Cronos Group Begins Commercial Production of CBG. Cronos Group Press Release. Jun. 4, 2021. 3 pages.

[No Author Listed], Cronos Group and Ginkgo Bioworks Announce Achievement of Equity Milestone in Partnership to Produce Cultured Cannabinoids. Cronos Group Press Release. Aug. 23, 2021. 3 pages.

[No Author Listed], olivetol synthase [Cannabis sativa]. GenBank Accession No. BAG14339.1. Jun. 20, 2009. Accessible at https://www.ncbi.nlm.nih.gov/protein/171363647. 2 pages.

[No Author Listed], Polyketide synthase 1. UniProt No. F1LKH6. Integrated into UniProt on Feb. 6, 2013; Entry last modified on Feb. 10, 2021; Accessible at https://www.uniprot.org/uniprot/F1LKH6. 5 pages.

[No Author Listed], Polyketide synthase 2. UniProt No. F1LKH7. Integrated into UniProt on Feb. 6, 2013; Entry last modified on Feb. 10, 2021; Accessible at https://www.uniprot.org/uniprot/F1LKH7. 5 pages.

[No Author Listed], Polyketide synthase 5. UniProt No. F1LKH9. Integrated into UniProt on Feb. 6, 2013; Entry last modified on Feb. 10, 2021; Accessible at https://www.uniprot.org/uniprot/F1LKH9. 5 pages.

[No Author Listed], Stilbenecarboxylate synthase 2. UniProt No. Q5I6Y1. Integrated into UniProt on Feb. 15, 2005; Entry last modified on Apr. 7, 2021; Accessible at https://www.uniprot.org/uniprot/Q5I6Y1. 5 pages.

[No Author Listed], Stilbenecarboxylate synthase. UniProt No. Q8GZP3. Integrated into UniProt on Mar. 1, 2003; Entry last modified on Apr. 7, 2021; Accessible at https://www.uniprot.org/uniprot/Q8GZP3. 4 pages.

[No Author Listed], unnamed protein product [Aspergillus niger]. GenBank Accession No. CAK49173.1. Mar. 14, 2015. Accessible at https://www.ncbi.nlm.nih.gov/protein/CAK49173.1/. 2 pages.

Aoki et al., Physiological role of germicidins in spore germination and hyphal elongation in Streptomyces coelicolor A3(2). J Antibiot (Tokyo). Sep. 2011;64(9):607-11. doi: 10.1038/ja.2011.59. Epub Jul. 27, 2011.

Flores-Sanchez, Polyketide synthases in *Cannabis sativa* L. Doctoral Thesis. Leiden University. Oct. 29, 2008. 176 pages.

Funa et al., Phenolic lipid synthesis by type III polyketide synthases is essential for cyst formation in Azotobacter vinelandii. Proc Natl Acad Sci USA. Apr. 18, 2006;103(16):6356-61. doi: 10.1073/pnas.0511227103. Epub Apr. 5, 2006.

Funabashi et al., Phenolic lipids synthesized by type III polyketide synthase confer penicillin resistance on Streptomyces griseus. J Biol Chem. May 16, 2008;283(20):13983-91. doi: 10.1074/jbc.M710461200. Epub Mar. 24, 2008. Erratum in: J Biol Chem. Sep. 5, 2008;283(36):25104.

Kealey et al., Production of a polyketide natural product in nonpolyketide-producing prokaryotic and eukaryotic hosts. Proc Natl Acad Sci U S A. Jan. 20, 1998;95(2):505-9. doi: 10.1073/pnas.95.2.505.

Larsen et al., Genome Mining and Evolutionary Analysis Reveal Diverse Type III Polyketide Synthase Pathways in Cyanobacteria. Genome Biol Evol. Apr. 5, 2021;13(4):evab056. doi: 10.1093/gbe/evab056. 15 pages.

Marks et al., Identification of candidate genes affecting $\Delta^9$-tetrahydrocannabinol biosynthesis in Cannabis sativa. J Exp Bot. 2009;60(13):3715-26. doi: 10.1093/jxb/erp210. Epub Jul. 6, 2009.

Morita et al., How structural subtleties lead to molecular diversity for the type III polyketide synthases. J Biol Chem. Oct. 11, 2019;294(41):15121-15136. doi: 10.1074/jbc.REV119.006129. Epub Aug. 30, 2019.

Navarro-Munoz et al., Evolutionary Histories of Type III Polyketide Synthases in Fungi. Front Microbiol. Jan. 21, 2020;10:3018. doi: 10.3389/fmicb.2019.03018. 18 pages.

Yu et al., Type III polyketide synthases in natural product biosynthesis. IUBMB Life. Apr. 2012;64(4):285-95. doi: 10.1002/iub.1005. Epub Feb. 23, 2012.

\* cited by examiner

| | | | |
|---|---|---|---|
| (SEQ ID NO: 65) | t51477 | MTQIHNATTEMTPVDQLYDSKITDFIRSGGHS----------------MEIKPSVIDAKTGQTLSQ | 51 |
| (SEQ ID NO: 63) | t49578 | -MSIIHKSPVP----DVQLEYGSWPDLMKTSPHA------H------NDSKFVVEDEDTKQQLTW | 48 |
| (SEQ ID NO: 64) | t49594 | MVQIIHKAFLGDMAESELFYGSIPDFMRSSREA------D----DDTRISVVDYDTDKAMTL | 52 |
| (SEQ ID NO: 69) | t392878 | MVQIIHKAFLGDMAESELFYGSIPDFMKSSREA------D----DDYTRISVVDYDTDKAMTL | 52 |
| (SEQ ID NO: 68) | t392879 | MVQIIHKAFLGDMAESELFYGSIPDFMRSSREA------D----DDTRISVVDYDTDKAMTL | 52 |
| (SEQ ID NO: 66) | t551127 | MGSSHHHHHHSSGTH-FS--IHAKSNPDKVAYRMASTGQALTY | 40 |
| (SEQ ID NO: 67) | t551128 | MGSSHHHHHHSSGNITHGLRKALQINFEEL---ATVCAGRRRNW | 41 |
| | | : | |

| | | | |
|---|---|---|---|
| | t51477 | AEMWQLSDKYAALLSSQYGLCRHRD----NELLDPSMGDVLITFGNVLLAPVVHWAALLDLG | 100 |
| | t49578 | KQVWQLSARLRAQLYHKYGIGKPGALAPFNDPSLGDVVLFYTFNTYSSLPYHLALHDLG | 108 |
| | t49594 | ARVFKVSGMLRAQFEHTIDVGKKK-----DGDANFKVIFYVGNTADMLACHIALHDLG | 105 |
| | t392878 | ARVFKVSGMLRAQFEHTIDVGKKK-----DGDANFKVIFYVGNTADNLACHIALHDLG | 105 |
| | t392879 | ARVFKVSGMLRAQFEHTIDVGKKK-----DGDANFKVIFYVGNTADMLACHIALHDLG | 105 |
| | t551127 | PQLDERSNQGAHLFRS-LGLK------AGDHIALLMENRLAFMETCWAAQRAG | 86 |
| | t551128 | REVGDRVARLAAGLRA-SSVG------EGERVAILSLNSDRYLEMYLAAGWCG | 87 |
| | | : : * | |

| | | | |
|---|---|---|---|
| | t51477 | ATISPGSTGYSAQDLARQFRKTTPKVVYAKAFKDVVDKATKL------YNSP--NPFA | 159 |
| | t49578 | ATISPASTSYDVKDICHQIVTTDAVVVDAALIVAEZAAPADVAREAVAK------SGRD----VR | 157 |
| | t49594 | AIISPASTAYDVNDLLRQINVVDAALIVAEAAPADVAREAVAK------AGDK-FKHVK | 157 |
| | t392878 | AIISPASTAYDVNDLLHQINVVDAALIVAEAAPADVAREAVAK------AGDK-FKHVK | 157 |
| | t392879 | AIISPASTAYDVNDLLHQINVVDAALIVAEAAPADVAREAVAK------AGDK-FKHVK | 157 |
| | t551127 | LYYTAISEYLTKDEIGYIVQDCGAKVVTTSAQGSETMKSLLSDGPGAPLYYMVD-PPTAG | 145 |
| | t551128 | GVIVPINIRWSALEMEDALRKDCRAVALVVDKAFFAATGGALAQAMPSMALIYADDGDVPPG | 147 |
| | | : : | |

| | | | |
|---|---|---|---|
| | t51477 | LVEHEALDKQARMVGNHRVERTRKIKLAPHESRTRIAYLGMSSGTKGGVSKAVRITHSNL | 219 |
| | t49578 | VVVMEDLINNAPTVAQMDIDSAPHVSLSRDQARAKIAYLGMSSGTSGGLPKAVRITHFNV | 217 |
| | t49594 | VVVFRELLEQMRKVRPRLIRVAPIVHLSKEQAYTTLAYLGMSSGTSGGVFKAVEITHRAM | 217 |
| | t392878 | VVVFRELLEQMRRVRPNLIRVAPIVHLSKEQAYTTLAYLGMSSGTSGGVPKAVEITHRFAM | 217 |
| | t392879 | VVVFRELLEQMRRVRPRLIRVAPIVHLSKEQAYTTLAYLGMSSGTSGGVPKAVEITHRAM | 217 |
| | t551127 | FRSWEQETAAQPT------TPI--ADEVAGYDMLYSSG------TTGRPKGIKREFEGN | 180 |
| | t551128 | MQSYEDLIATHAP--------IPDAMRRAEDLAGIFYTGG------TTGRSKGVMLSHGNL | 194 |
| | | : * | |

```
(SEQ ID NO: 26)  t394911  ------------------------------------------------MNRIIQMEKR  10
(SEQ ID NO: 6)   t393974  ------------------------------------------------MASSIE     6
(SEQ ID NO: 27)  t393720  --------------------------------------MSSLSNSLPLMEDVQG    16
(SEQ ID NO: 8)   t394336  ---------------------------------------------MPGLKNRKK     9
(SEQ ID NO: 7)   t393991  ---------------------------------------------MPSLES--     6
(SEQ ID NO: 15)  t395011  ---------------------------------------------MPSLKS--     6
(SEQ ID NO: 5)   t339568  --------------------------------------------------------    0
(SEQ ID NO: 30)  t339579  --------------------------------------------------------    0
(SEQ ID NO: 31)  t339582  --------------------------------------------------------    0
(SEQ ID NO: 10)  t394457  ---------------------------------------------MSAEMTVDLET   11
(SEQ ID NO: 11)  t394521  ---------------------------------------------MSVGMGVDLEA   11
(SEQ ID NO: 26)  t394435  ------------------------------------------MATPLYSSSLSVDE  14
(SEQ ID NO: 17)  t395094  -----------------------------------------------MSMENVEA     8
(SEQ ID NO: 1)   t394087  -------------------------------------------------MVDINT     6
(SEQ ID NO: 29)  t395023  ---------------------------------------------MATKSVAVEE   10
(SEQ ID NO: 19)  t395103  -----------------------------------------------MAHLEE      6
(SEQ ID NO: 2)   t346687  -----------------------------------------------MAFMEE      6
(SEQ ID NO: 19)  t393835  ------------------------------------------------MASVEE     6
(SEQ ID NO: 22)  t394037  ------------------------------------------------MASVEE     6
(SEQ ID NO: 13)  t394905  ------LAKSFVFAKTATVEE                                      48
(SEQ ID NO: 4)   t393563  MASLCHIPFQKQMSNCRTVHPIFGQKSRLLIKN---------------MTTGKVTLEA  10
(SEQ ID NO: 14)  t394981  ----------------------------------------------MAAKVTVEE     9
(SEQ ID NO: 12)  t394790  ------------------------------------------------MVSVSE     6
(SEQ ID NO: 16)  t394797  ------------------------------------------------MVSVSG     6
(SEQ ID NO: 21)  t394091  MININRTIIWDF---NLPRFPLPLYNHRSTLLFTTTCISQSHFSLLVIEKQMASSIDIAA 56
(SEQ ID NO: 24)  t394043  ------------------------------------------------NMKVSE     6
(SEQ ID NO: 25)  t394404  ------------------------------------------------NVTVEE     6
(SEQ ID NO: 3)   t393495  --------------------------------------------MVMGA-LSLDE   10
(SEQ ID NO: 9)   t394547  --------------------------------------------MVMKGA-LSLDE   10
(SEQ ID NO: 20)  t394115  --------------------------------------------MVMGDMPSLDE   11
(SEQ ID NO: 23)  t394279  --------------------------------------------MVMAGASSLDE   11
```

| | | |
|---|---|---|
| t394911 | SKNEGKGTGEGLEWGVLLGFGPGVALETVLLHSVSCVKQ---- | 400 |
| t393974 | SIKQSKSTTGQGLEWGVLLALGPGLTVETTGLRSCVVAGVASR | 396 |
| t393720 | SAAKGLETVGEGLEWGVLLSFGPGLTVETTLLHSLPLM---- | 403 |
| t394336 | STEEGKTTGEGFDWGVLFGFGPGLTVETVILHSVPL------ | 394 |
| t393991 | SKKEGKATTGEGLDWGVLFGFGPGLTVETVVLHSVPI----- | 390 |
| t395011 | SAMEGKATTGEGLDWGVLFGFGPGLTVETVVLRSVPL----- | 390 |
| t339568 | SLEEGKSTTGDGFEWGVLFGFGPGLTVERVVSVPIKY---- | 385 |
| t339579 | SLEEGKSTTGDGFEWGVLFGFGPGLTVERVVRSVPIKY---- | 385 |
| t339582 | SLEEGKSTTGDGFEWGVLFGFGPGLTVERVVRSVPIKY---- | 385 |
| t394457 | SREMGISTTGEGLEMGVLFGFGPGLTVETVVLKSVLLP---- | 396 |
| t394521 | SRQMGCSTSGGFQMSVLFGFGPGVAFGFGPGLTVETVLKSIPFP---- | 396 |
| t394436 | SMIDGMATTGDGLDWGVAFGFGPGLTVETVLRSIPVTSFT-- | 398 |
| t395094 | SRRGGCANTGEGLDLGVLFGFGPGLTVETVVLRSVRLQ---- | 392 |
| t394087 | SVQEGLQTTGEGLEWGVLFGFGPGFTVETIVLHSVPI----- | 393 |
| t395023 | SVEEGKSTTGEGLEWGVLKWGVLYGPGLTVETIVLHSAADENN-- | 399 |
| t395103 | SLEKGKSTTGEGLDWGVLFGFGPGLTWETIVLHSAADENN-- | 393 |
| t394687 | SLKEGKTTGEGLDWGVLFGFGPGLTIETVVLHSVGTDSN--- | 392 |
| t393835 | SLKREKATTGEGLDWGVLFGFGPGLTVTVELHSVPMITR--- | 392 |
| t394037 | SIKEGLGTTGEGLEWGALCGFGPGLTIETIVLHSISI----- | 431 |
| t394905 | SAKDGHTTGEGMEWGVLFGFGPGLTVETIVLHSVPITTVAA- | 398 |
| t393563 | SAKDGRATTGEGMDWGVLFGFGPGLTVETVVLHSVPITTGHAA | 398 |
| t394981 | SLEEGLKTTGEGLDWGVLFGFGPGLTVETVVLHSVPL----- | 389 |
| t394790 | SLEEGLKTTGEGLDWGVLFGFGPGLTVETIVLHSVPL----- | 389 |
| t394797 | SAQDGLKTTGEGLEWGVTLSFGPGLTVETVVLHSVPL----- | 389 |
| t394491 | SVEDGSAATTGEGLDWGVLFGFGPGLTVETVVLHSVPTIRPIVP | 447 |
| t394043 | AVEDGFKTTGEGLEWGVLFGFGPGLTVETVVLHSVPL----- | 389 |
| t394404 | AVEDGSARTTGEGLEWGVLFGFGPGLTVETVVLHSVPL---- | 394 |
| t393495 | SAKDGVATTGEGLEWGVLFGFGPGLTVETVVLHSVPL----- | 385 |
| t394547 | SAKDGVATTGEGLEWGVLFGFGPGLTVETVVLHSVPL----- | 395 |

FIG. 11H

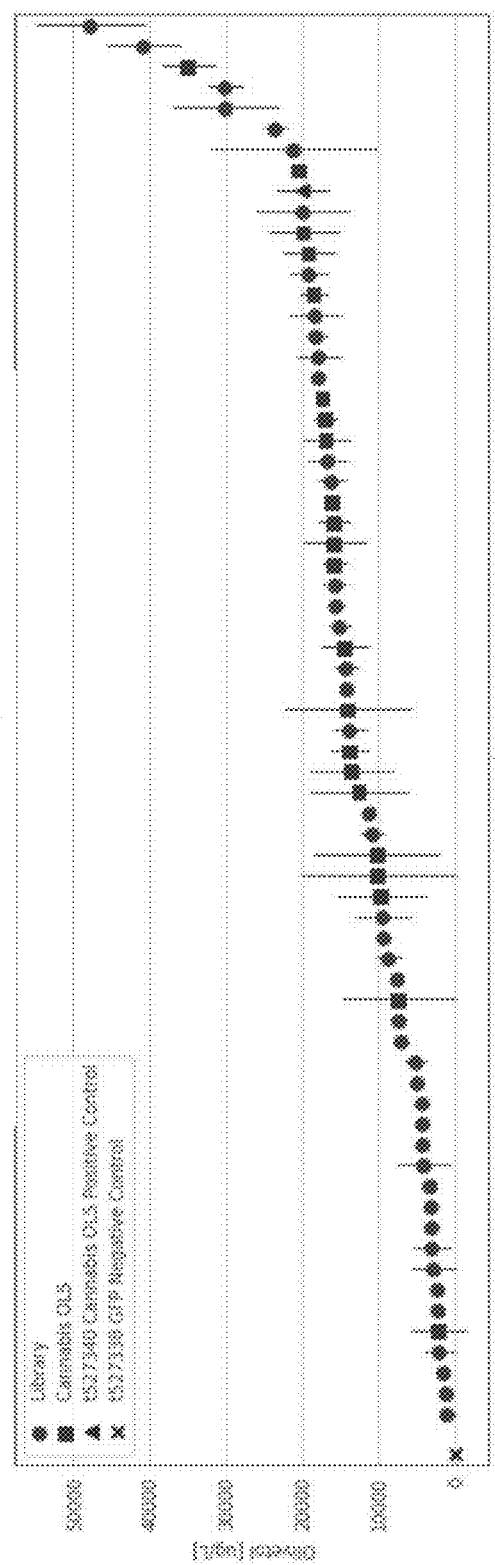
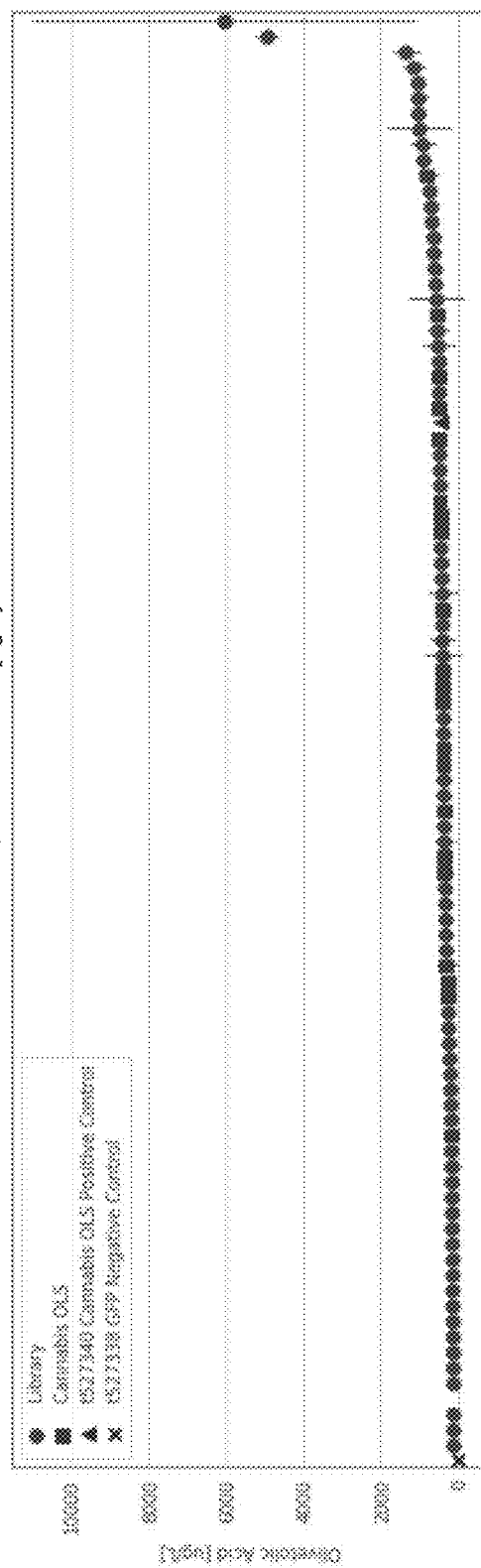
FIG. 12A
FIG. 12B

BIOSYNTHESIS OF CANNABINOIDS AND CANNABINOID PRECURSORS

CROSS-REFERENCE TO RELATED APPLICATIONS

This application is a continuation of International Application Serial Number PCT/US2020/019760, filed Feb. 25, 2020, entitled "BIOSYNTHESIS OF CANNABINOIDS AND CANNABINOID PRECURSORS," which claims the benefit under 35 U.S.C. § 119(e) of U.S. Provisional Application Ser. No. 62/810,367, filed Feb. 25, 2019, entitled "BIOSYNTHESIS OF CANNABINOIDS AND CANNABINOID PRECURSORS," and U.S. Provisional Application Ser. No. 62/810,938, filed Feb. 26, 2019, entitled "BIOSYNTHESIS OF CANNABINOIDS AND CANNABINOID PRECURSORS," the disclosure of each of which is incorporated by reference herein in its entirety.

REFERENCE TO A SEQUENCE LISTING SUBMITTED AS A TEXT FILE VIA EFS-WEB

The instant application contains a Sequence Listing which has been submitted in text format via EFS-Web and is hereby incorporated by reference in its entirety. Said text copy, created on Oct. 23, 2020, is named G091970030US07-SEQ-FL.txt and is 1,806,581 bytes in size.

FIELD OF INVENTION

The present disclosure relates to the biosynthesis of cannabinoids and cannabinoid precursors in recombinant cells.

BACKGROUND

Cannabinoids are chemical compounds that may act as ligands for endocannabinoid receptors and have multiple medical applications. Traditionally, cannabinoids have been isolated from plants of the genus *Cannabis*. The use of plants for producing cannabinoids is inefficient, however, with isolated products restricted to the primary endogenous *Cannabis* compounds, and the cultivation of *Cannabis* plants is restricted in many jurisdictions. Cannabinoids can also be produced through chemical synthesis (see, e.g., U.S. Pat. No. 7,323,576 to Souza et al). However, such methods suffer from low yields and high cost. Production of cannabinoids, cannabinoid analogs, and cannabinoid precursors using engineered organisms may provide an advantageous approach to meet the increasing demand for these compounds.

SUMMARY

Aspects of the present disclosure provide methods for production of cannabinoids and cannabinoid precursors from fatty acid substrates using genetically modified host cells.

Aspects of the present disclosure provide host cells that comprises a heterologous polynucleotide encoding a polyketide synthase (PKS), wherein the PKS comprises a sequence that is at least 90% identical to SEQ ID NO: 7. In some embodiments, relative to the sequence of SEQ ID NO: 7, the PKS comprises an amino acid substitution at a residue corresponding to position 34, 50, 70, 71, 76, 100, 151, 203, 219, 285, 359, and/or 385 in SEQ ID NO: 7. In some embodiments, the PKS comprises: the amino acid Q at a residue corresponding to position 34 in SEQ ID NO: 7; the amino acid N at a residue corresponding to position 50 in SEQ ID NO: 7; the amino acid M at a residue corresponding to position 70 in SEQ ID NO: 7; the amino acid Y at a residue corresponding to position 71 in SEQ ID NO: 7; the amino acid I at a residue corresponding to position 76 in SEQ ID NO: 7; the amino acid P or T at a residue corresponding to position 100 in SEQ ID NO: 7; the amino acid P at a residue corresponding to position 151 in SEQ ID NO: 7; the amino acid K at a residue corresponding to position 203 in SEQ ID NO: 7; the amino acid C at a residue corresponding to position 219 in SEQ ID NO: 7; the amino acid A at a residue corresponding to position 285 in SEQ ID NO: 7; the amino acid M at a residue corresponding to position 359 in SEQ ID NO: 7; and/or the amino acid M at a residue corresponding to position 385 in SEQ ID NO: 7.

In some embodiments, the PKS is capable of producing:
a) a compound of Formula (4):

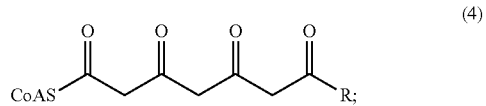

b) a compound of Formula (5):

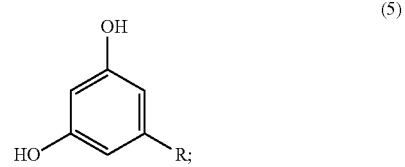

and/or c) a compound of Formula (6):

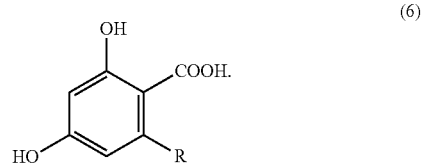

In some embodiments,
a) the compound of Formula (4) is the compound for Formula (4a):

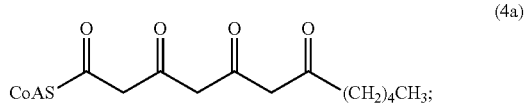

b) the compound of Formula (5) is the compound for Formula (5a):

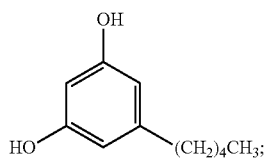

and/or c) the compound of Formula (6) is the compound of Formula (6a):

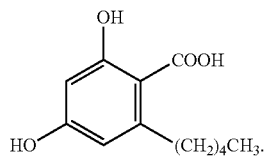

In some embodiments, the host cell produces more of a compound of Formula (5) than a host cell that comprises a heterologous polynucleotide encoding a PKS that comprises the sequence of SEQ ID NO: 7. In some embodiments, the PKS comprises one or more of the following amino acid substitutions relative to SEQ ID NO: 7: V71Y and F70M. In some embodiments, the PKS comprises: C at a residue corresponding to position 164 in SEQ ID NO: 7; H at a residue corresponding to position 304 in SEQ ID NO: 7; and/or N at a residue corresponding to position 337 in SEQ ID NO: 7. In some embodiments, the PKS comprises SEQ ID NO: 7. In some embodiments, the PKS comprises SEQ ID NO: 15 or 145. In some embodiments, the heterologous polynucleotide comprises a sequence that is at least 90% identical to SEQ ID NOs: 38 or 176.

Aspects of the present disclosure relate to host cell that comprises a heterologous polynucleotide encoding a polyketide synthase (PKS), wherein the PKS comprises a sequence that is at least 90% identical to SEQ ID NO: 714. In some embodiments, the PKS is capable of producing:

a. a compound of Formula (4):

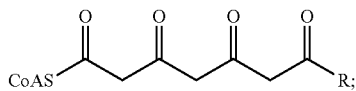

b. a compound of Formula (5):

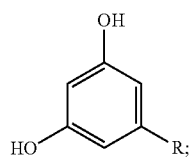

and/or c. a compound of Formula (6):

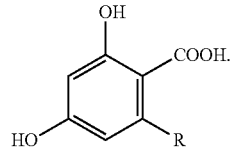

In some embodiments, a) the compound of Formula (4) is the compound for Formula (4a):

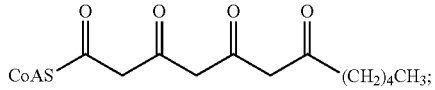

b) the compound of Formula (5) is the compound for Formula (5a):

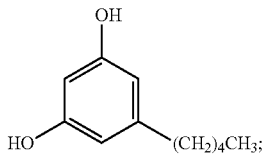

and/or c) the compound of Formula (6) is the compound of Formula (6a):

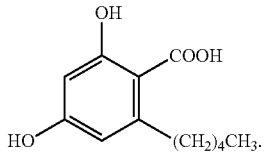

Further aspects of the present disclosure provide host cells that comprises a heterologous polynucleotide encoding a polyketide synthase (PKS), wherein relative to the sequence of SEQ ID NO: 5 the PKS comprises one or more amino acid substitutions within the active site of the PKS, and wherein the host cell is capable of producing a compound of Formula (4), (5), or (6).

In some embodiments, relative to SEQ ID NO: 5, the PKS comprises an amino acid substitution at one or more of the following positions in SEQ ID NO: 5: 17, 23, 25, 51, 54, 64, 95, 123, 125, 153, 196, 201, 207, 241, 247, 267, 273, 277, 296, 307, 320, 324, 326, 328, 334, 335C, and 375. In some embodiments, relative to SEQ ID NO:5, the PKS comprises: T17K, I23C, L25R, K51R, D54R, F64Y, V95A, T123C, A125S, Y153G, E196K, L201C, I207L, L241I, T247A, M267K, M267G, I273V, L277M, T296A, V307I, D320A, V324I, S326R, H328Y, S334P, S334A, T335C, R375T, or any combination thereof. In some embodiments, relative to SEQ ID NO: 5, the PKS further comprises an amino acid substitution at one or more of the following positions in SEQ ID NO: 5: 284, 100, 116, 278, 108, 348, 71, 92, 128, 100, 135, 229, 128, and 128. In some embodiments, relative to SEQ ID NO:5, the PKS comprises: I284Y, K100L, K116R, 1278E, K108D, L348S, K71R, V92G, T128V, K100M, Y135V, P229A, T128A, T128I, or any combination thereof. In some embodiments, a) the compound of Formula (4) is the compound of Formula (4a):

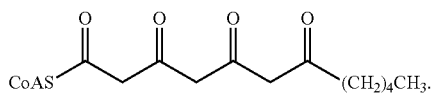
(4a)

b) the compound of Formula (5) is the compound of Formula (5a):

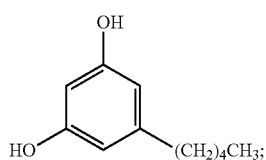
(5a)

and/or c) the compound of Formula (6) is the compound of Formula (6a):

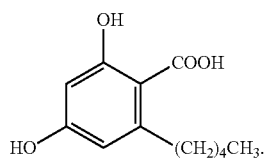
(6a)

In some embodiments, the host cell produces more of a compound of Formula (5) than a host cell that comprises a heterologous polynucleotide encoding a PKS that comprises the sequence of SEQ ID NO: 5. In some embodiments, the PKS comprises at least 90% to any one SEQ ID NOs: 207-249. In some embodiments, the heterologous polynucleotide comprises a sequence that is at least 90% identical to SEQ ID NOs: 250-292.

Further aspects of the present disclosure relate to host cells that comprises a heterologous polynucleotide encoding a polyketide synthase (PKS), wherein relative to the sequence of SEQ ID NO: 5 the PKS comprises the amino acid substitution T335C. In some embodiments, the PKS is at least 90% identical to SEQ ID NO: 207. In some embodiments, the PKS comprises SEQ ID NO: 207.

Further aspects of the present disclosure relate to host cells that comprises a heterologous polynucleotide encoding a polyketide synthase (PKS), wherein the PKS comprises the amino acid C at a residue corresponding to position 335 of SEQ ID NO: 5, and wherein the host cell is capable of producing more of a compound of Formula (5) than a host cell that comprises a heterologous polynucleotide encoding a PKS comprising SEQ ID NO: 5.

In some embodiments, the PKS comprises a sequence that is at least 90% identical to any one of SEQ ID NOs: 7, 13, 145, 8, and 15. In some embodiments, the PKS comprises a sequence that is at least 90% identical to SEQ ID NO: 5. In some embodiments, the compound of Formula (5) is the compound of Formula (5a):

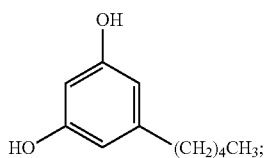
(5a)

In some embodiments, the heterologous polynucleotide comprises a sequence that is at least 90% identical to SEQ ID NO: 250 or 706.

Further aspects of the present disclosure provide host cells that comprises a heterologous polynucleotide encoding a polyketide synthase (PKS), wherein the PKS is capable of reacting a compound of Formula (2) with a compound of Formula (3):

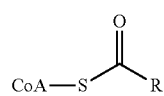
(2)

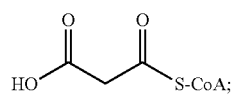
(3)

to produce a compound of Formula (6):

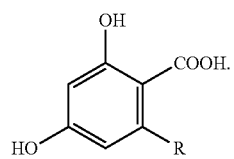
(6)

In some embodiments, the PKS comprises a sequence that is at least 90% identical to SEQ ID NO: 6. In some embodiments, the PKS comprises the amino acid W at a residue corresponding to position 339 of SEQ ID NO: 6. In some embodiments, the PKS comprises: C at a residue corresponding to position 164 in SEQ ID NO: 6; H at a residue corresponding to position 304 in SEQ ID NO: 6; and/or N at a residue corresponding to position 337 in SEQ ID NO: 6. In some embodiments, the PKS is capable of producing:

a compound of Formula (4):

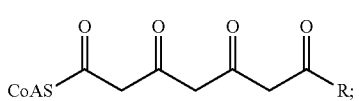
(4)

b) or a compound of Formula (5):

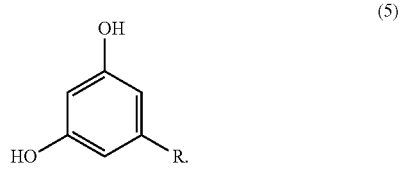

In some embodiments,
the compound of Formula (6) is a compound for Formula (6a):

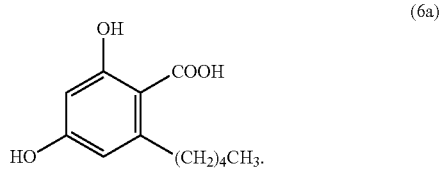

In some embodiments,
a) the compound of Formula (4) is a compound for Formula (4a):

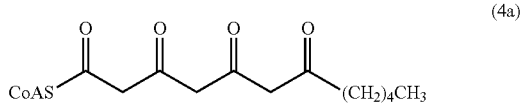

and/or
b) the compound of Formula (5) is a compound for Formula (5a):

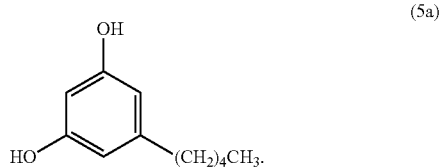

In some embodiments,
a. the compound of Formula (2) is a compound of Formula (2a):

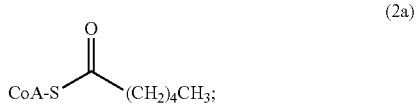

and/or
b. the compound of Formula (3) is a compound of Formula (3a):

In some embodiments, the host cell produces a ratio of compound (6) to compound (5) that is higher than the ratio produced by a host cell that comprises a heterologous polynucleotide encoding a PKS that comprises the sequence of SEQ ID NO: 6. In some embodiments, the PKS comprises SEQ ID NO: 6. In some embodiments, the heterologous polynucleotide comprises a sequence that is at least 90% identical to SEQ ID NO: 37 or 186.

Further aspects of the disclosure provide host cells that comprises a heterologous polynucleotide encoding an acyl activating enzyme (AAE), wherein the AAE comprising a sequence that is at least 90% identical to a sequence selected from SEQ ID NOs: 63-69, 141-142, and 707-708.

Further aspects of the disclosure provide host cell that comprises a heterologous polynucleotide comprising a sequence that is at least 90% identical to a sequence selected from SEQ ID NOs: 70-76 and 712-713.

Further aspects of the disclosure provide host cells that comprises a heterologous polynucleotide encoding an acyl activating enzyme (AAE), wherein the AAE comprises: the amino acid sequence SGAAPLG (SEQ ID NO: 114); the amino acid sequence AYLGMSSGTSGG (SEQ ID NO: 115); the amino acid sequence DQPA (SEQ ID NO: 116); the amino acid sequence QVAPAELE (SEQ ID NO: 117); the amino acid sequence VVID (SEQ ID NO: 118); and/or the amino acid sequence SGKILRRLLR (SEQ ID NO: 119). In some embodiments, the host cell produces at least 10%, 20%, 30%, 40%, 50%, 60%, 70%, 80%, 90%, or 100% more hexanoyl-coenzyme A in the presence of hexanoic acid and Coenzyme A relative to a recombinant host cell that does not comprise a heterologous gene encoding an AAE and/or the host cell produces at least 10%, 20%, 30%, 40%, 50%, 60%, 70%, 80%, 90%, or 100% more butanoyl-coenzyme A in the presence of butyric acid and Coenzyme A relative to a recombinant host cell that does not comprise a heterologous gene encoding an AAE.

In some embodiments, the AAE comprises: the amino acid sequence SGAAPLG (SEQ ID NO: 114) at residues corresponding to positions 319-325 in SEQ ID NO:64; the amino acid sequence AYLGMSSGTSGG (SEQ ID NO: 115) at residues corresponding to positions 194-205 in SEQ ID NO:64; the amino acid sequence DQPA (SEQ ID NO: 116) at residues corresponding to positions 398-401 in SEQ ID NO:64; the amino acid sequence QVAPAELE (SEQ ID NO: 117) at residues corresponding to positions 495-502 in SEQ ID NO:64; the amino acid sequence VVID (SEQ ID NO: 118) at residues corresponding to positions 564-567 in SEQ ID NO:64; and/or the amino acid sequence SGKILRRLLR (SEQ ID NO: 119) at residues corresponding to positions 574-583 in SEQ ID NO:64.

Further aspects of the disclosure provide host cells that comprises a heterologous polynucleotide encoding an acyl activating enzyme (AAE), wherein the AAE comprises: an amino acid sequence with no more than three amino acid substitutions at residues corresponding to positions 428-440 in SEQ ID NO:64; or an amino acid sequence with no more than one amino acid substitution at residues corresponding to positions 482-491 in SEQ ID NO:64, wherein the host cell produces at least 10%, 20%, 30%, 40%, 50%, 60%, 70%, 80%, 90%, or 100% more hexanoyl-coenzyme A in the presence of hexanoic acid and Coenzyme A relative to a recombinant host cell that does not comprise a heterologous gene encoding an AAE; and/or wherein the host cell produces at least 10%, 20%, 30%, 40%, 50%, 60%, 70%, 80%, 90%, or 100% more butanoyl-coenzyme A in the presence of butyric acid and Coenzyme A relative to a recombinant host cell that does not comprise a heterologous gene encoding an AAE.

In some embodiments, the AAE comprises: I or V at a residue corresponding to position 432 in SEQ ID NO:64; S or D at a residue corresponding to position 434 in SEQ ID NO:64; K or N at a residue corresponding to position 438 in SEQ ID NO:64; and/or L or M at a residue corresponding to position 488 in SEQ ID NO:64. In some embodiments, the AAE comprises: the amino acid sequence RGPQIM-SGYHKNP (SEQ ID NO: 120); the amino acid sequence RGPQVMDGYHNNP (SEQ ID NO: 121); the amino acid sequence RGPQIMDGYHKNP (SEQ ID NO: 122); the amino acid sequence VDRTKELIKS (SEQ ID NO: 123); and/or the amino acid sequence VDRTKEMIKS (SEQ ID NO: 124). In some embodiments, the AAE comprises a sequence that is at least 90% identical to a sequence selected from SEQ ID NOs: 63-69, 141-142, and 707-708. In some embodiments, the AAE comprises at least one conservative substitution relative to the sequence of SEQ ID NO:64. In some embodiments, the host cell further comprises one or more heterologous polynucleotides encoding one or more of: a polyketide synthase (PKS), a polyketide cyclase (PKC); a prenyltransferase (PT); and/or a terminal synthase (TS).

Further aspects of the present disclosure provide methods comprising culturing any of the host cells of the disclosure. In some embodiments, the host cell is cultured in media comprising sodium hexanoate. In some embodiments, the host cell is a plant cell, an algal cell, a yeast cell, a bacterial cell, or an animal cell. In certain embodiments, the host cell is a yeast cell. In some embodiments, the yeast cell is a *Saccharomyces* cell, a *Yarrowia* cell, a *Pichia* cell or a *Komagataella* cell. In certain embodiments, wherein the *Saccharomyces* cell is a *Saccharomyces cerevisiae* cell. In some embodiments, the host cell is a bacterial cell. In certain embodiments, the bacterial cell is an *E. coli* cell. In some embodiments, the host cell further comprises one or more heterologous polynucleotides encoding one or more of: an acyl activating enzyme (AAE), a polyketide cyclase (PKC), a prenyltransferase (PT), and/or a terminal synthase (TS).

Further aspects of the present disclosure provide non-naturally occurring nucleic acid encoding a polyketide synthase (PKS), wherein the non-naturally occurring nucleic acid comprises at least 90% identity to SEQ ID NOs: 32-62, 93-108, 172-206, 250-292, 421-548, 628-705 or 706. Further aspects of the present disclosure provide vectors comprising non-naturally occurring nucleic acids of the disclosure. Further aspects of the present disclosure provide expression cassettes comprising non-naturally occurring nucleic acids of the disclosure. Further aspects of the present disclosure provide host cells transformed with non-naturally occurring nucleic acids, vector, or expression cassettes of the present disclosure. Further aspects of the present disclosure provide host cells that comprise non-naturally occurring nucleic acids, vector, or expression cassettes of the present disclosure.

Each of the limitations of the invention can encompass various embodiments of the invention. It is, therefore, anticipated that each of the limitations of the invention involving any one element or combinations of elements can be included in each aspect of the invention. This disclosure is not limited in its application to the details of construction and the arrangement of components set forth in the following description or illustrated in the drawings. The invention is capable of other embodiments and of being practiced or of being carried out in various ways. Also, the phraseology and terminology used in this application is for the purpose of description and should not be regarded as limiting. The use of "including," "comprising," or "having," "containing," "involving," and variations thereof, is meant to encompass the items listed thereafter and equivalents thereof as well as additional items.

BRIEF DESCRIPTION OF DRAWINGS

The accompanying drawings are not intended to be drawn to scale. In the drawings, each identical or nearly identical component that is illustrated in various figures is represented by a like numeral. For purposes of clarity, not every component may be labeled in every drawing. In the drawings:

FIG. 1 is a schematic depicting the native *Cannabis* biosynthetic pathway for production of cannabinoid compounds, including five enzymatic steps mediated by: (R1a) acyl activating enzymes (AAE); (R2a) olivetol synthase enzymes (OLS); (R3a) olivetolic acid cyclase enzymes (OAC); (R4a) cannabigerolic acid synthase enzymes (CBGAS); and (R5a) terminal synthase enzymes (TS). Formulae 1a-11a correspond to hexanoic acid (1a), hexanoyl-CoA (2a), malonyl-CoA (3a), 3,5,7-trioxododecanoyl-CoA (4a), olivetol (5a), olivetolic acid (6a), geranyl pyrophosphate (7a), cannabigerolic acid (8a), cannabidiolic acid (9a), tetrahydrocannabinolic acid (10a), and cannabichromenic acid (11a). Hexanoic acid is an exemplary carboxylic acid substrate; other carboxylic acids may also be used (e.g., butyric acid, isovaleric acid, octanoic acid, decanoic acid, etc.; see e.g., FIG. 3 below). The enzymes that catalyze the synthesis of 3,5,7-trioxododecanoyl-CoA and olivetolic acid are shown in R2a and R3a, respectively, and can include multifunctional enzymes that catalyze the synthesis of 3,5,7-trioxododecanoyl-CoA and olivetolic acid. The enzymes cannabidiolic acid synthase (CBDAS), tetrahydrocannabinolic acid synthase (THCAS), and cannabichromenic acid synthase (CBCAS) that catalyze the synthesis of cannabidiolic acid, tetrahydrocannabinolic acid, and cannabichromenic acid, respectively, are shown in step R5a. FIG. 1 is adapted from Carvalho et al. "Designing Microorganisms for Heterologous Biosynthesis of Cannabinoids" (2017) *FEMS Yeast Research* June 1; 17(4), which is incorporated by reference in its entirety.

Error bars represent the standard deviation of 2 independent measurements. Negative control strain t49568 expresses an aldehyde dehydrogenase protein from *Y. lipolytica* (corresponding to Uniprot ID Q6C5T1).

Figure 5A:
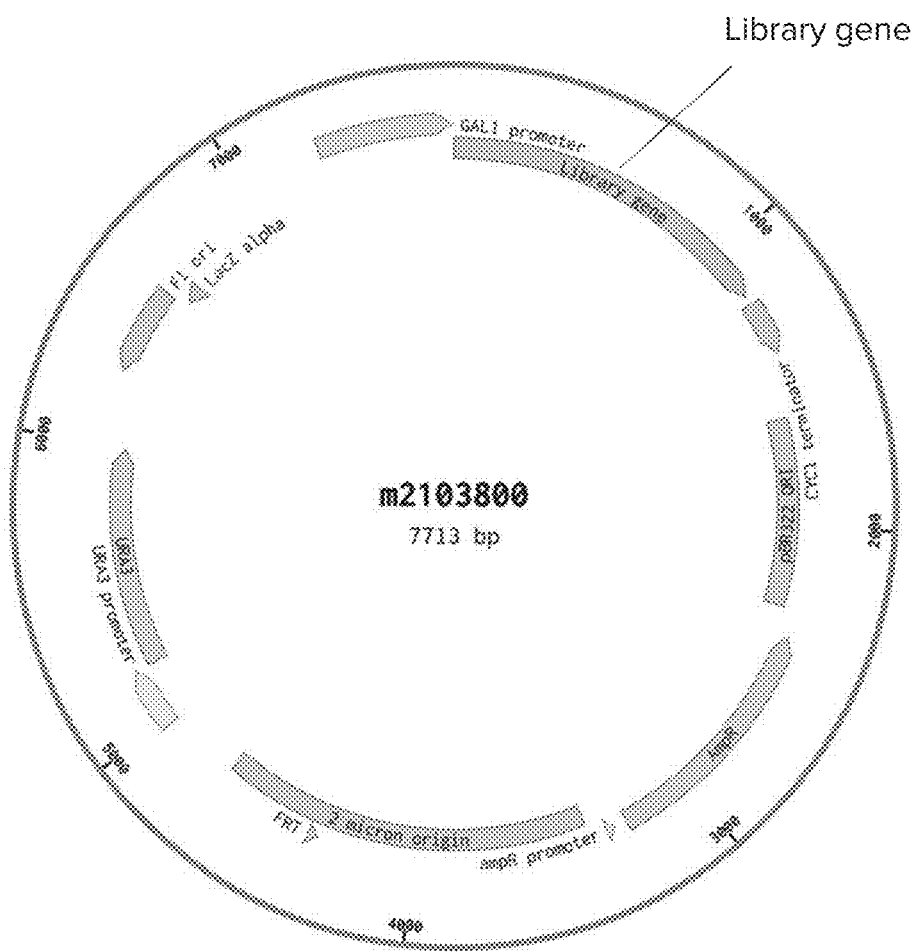
Figure 5B:
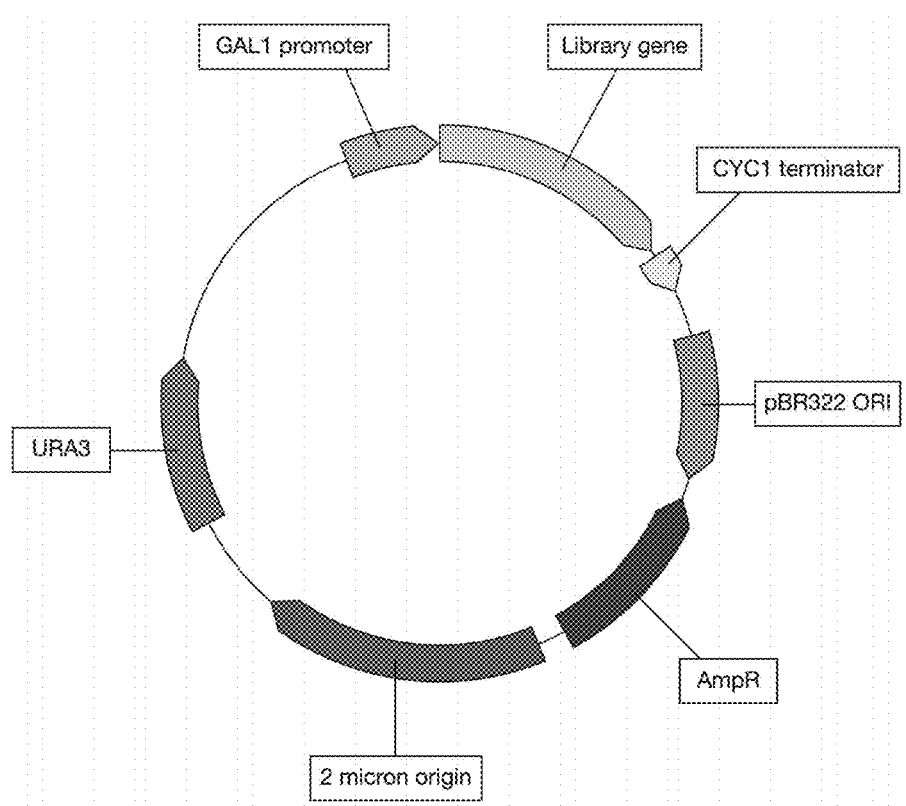

FIGS. 5A-5B show a plasmid used to express AAE and OLS proteins in *S. cerevisiae*. The coding sequence for the enzyme being expressed (labeled "Library gene") is driven by the GAL1 promoter. The plasmid contains markers for both yeast (URA3) and bacteria (ampR), as well as origins of replication for yeast (2 micron), bacteria (pBR322), and phage (f1).

Figure 6:
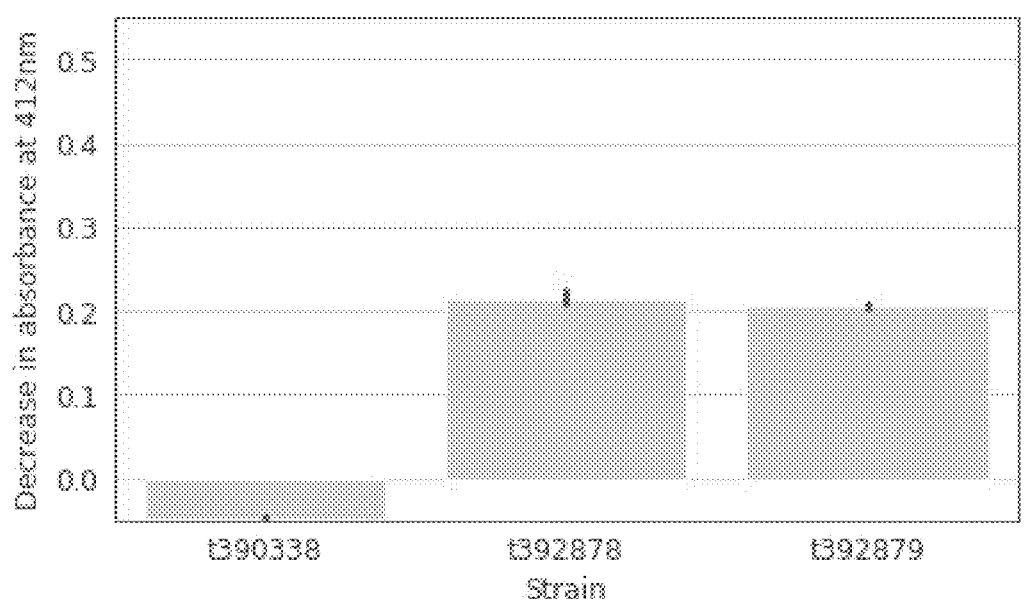

FIG. 6 is a graph showing activity of *S. cerevisiae* strains expressing candidate AAEs as measured by a DTNB assay. Lysates of *S. cerevisiae* expressing candidate AAEs were assayed for ligation activity of free CoA to hexanoate. Activity was quantified by measuring the decrease in absorbance at 412 nm, corresponding to a decrease of free CoA in solution. Error bars represent the standard deviation of 3 independent measurements. Negative control strain t390338 expresses GFP.

Figure 7B:
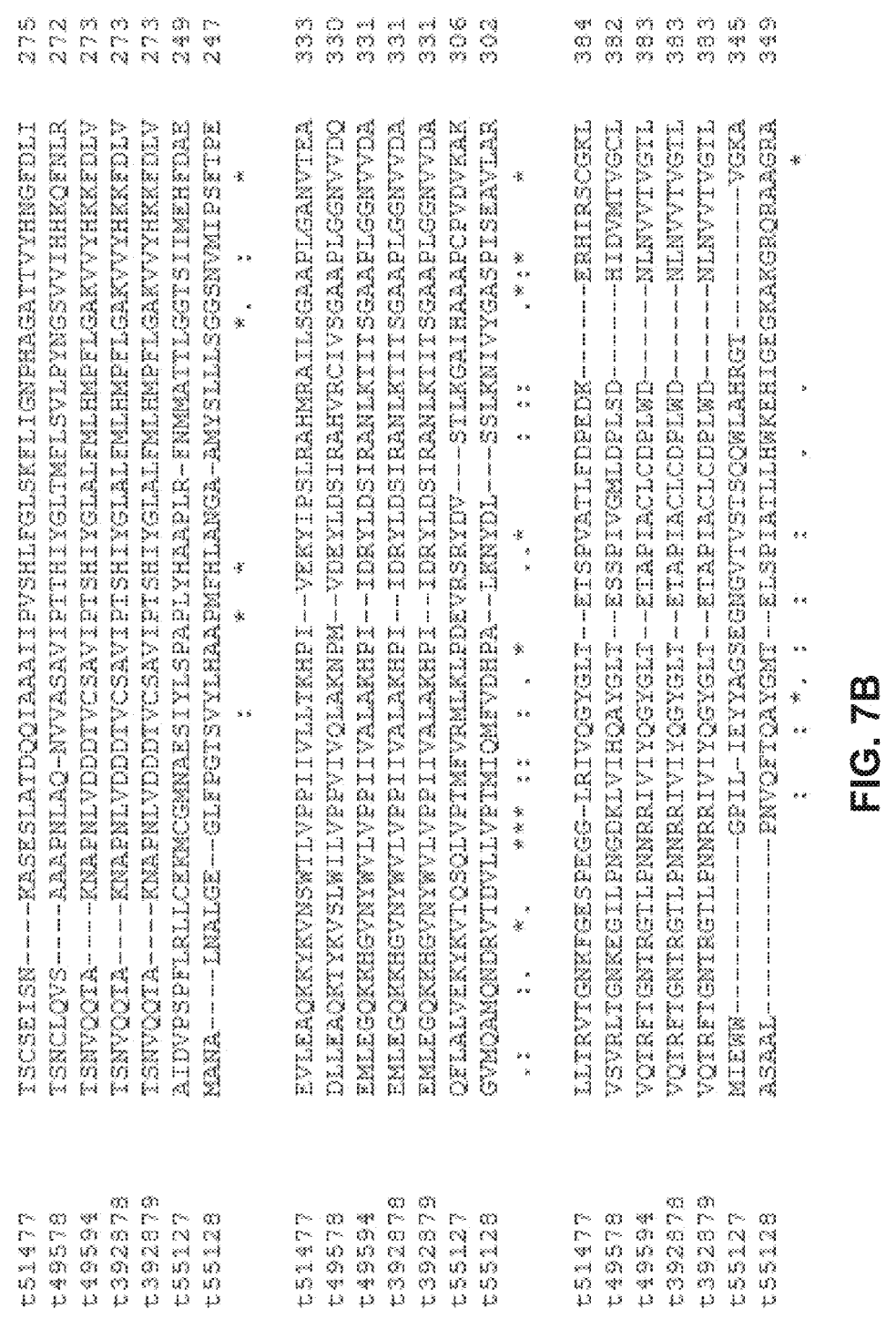
Figure 7C:
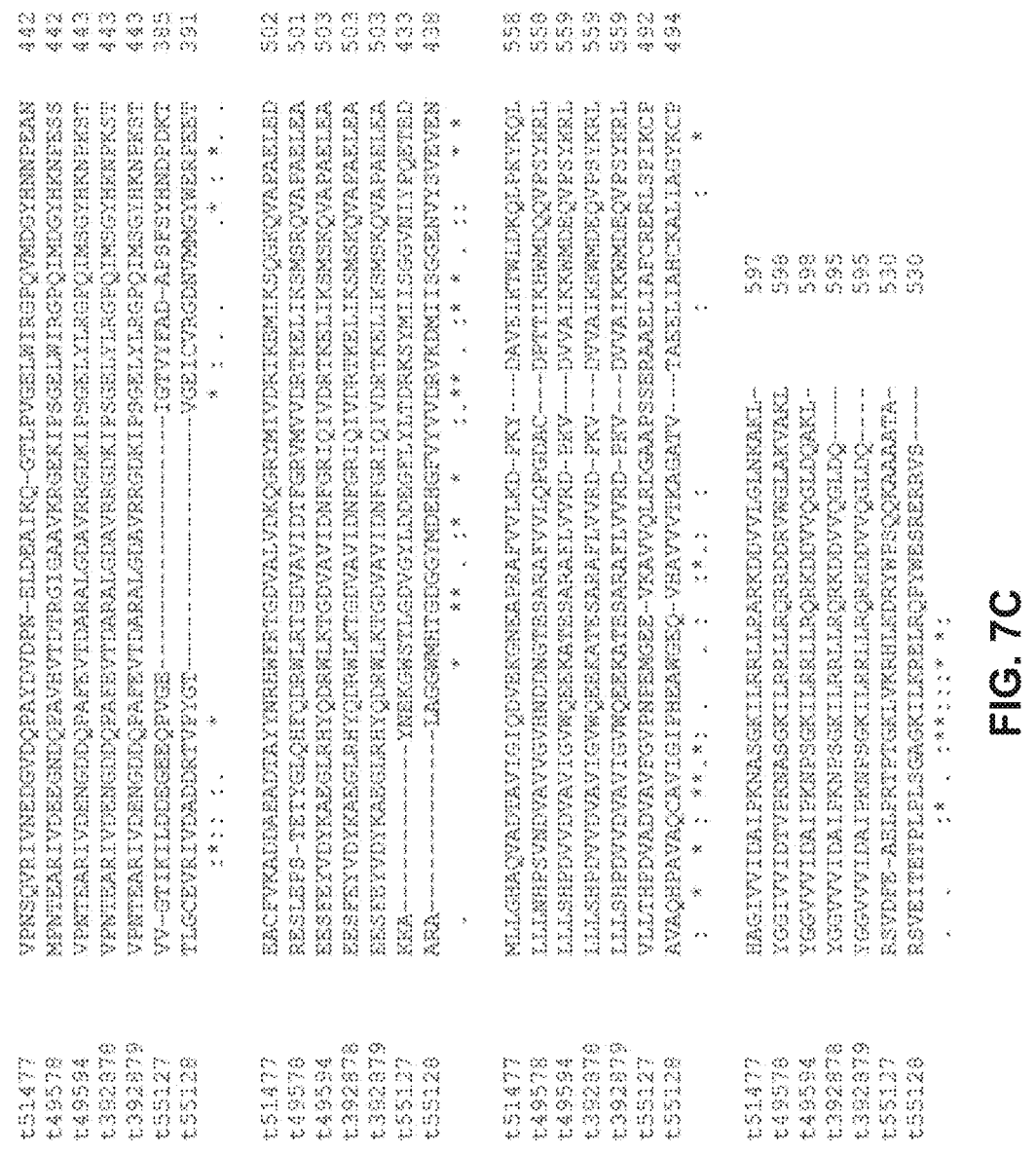

FIGS. 7A-7C show a sequence alignment of acyl activating enzymes (AAEs). An alignment of t51477 (SEQ ID NO: 65), t49578 (SEQ ID NO: 63), t49594 (SEQ ID NO: 64), t392878 (SEQ ID NO: 68), t392879 (SEQ ID NO: 69), t55127 (SEQ ID NO: 66), and t55128 (SEQ ID NO: 67) is shown. The sequence alignment was conducted using Clustal Omega. See, e.g., Chojnacki et al., *Nucleic Acids Res.* 2017 Jul. 3; 45(W1):W550-W553.

Figure 8:
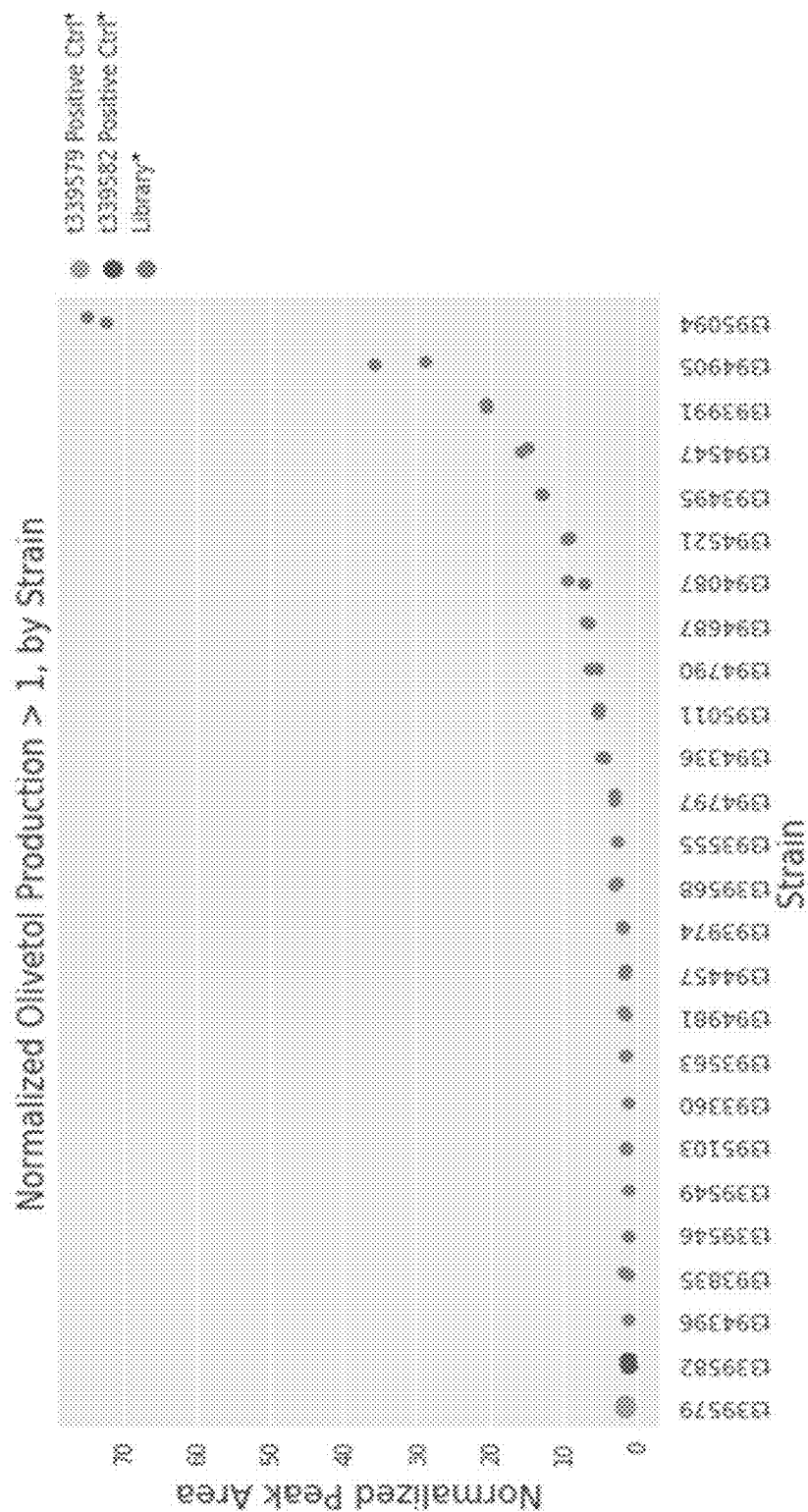

FIG. 8 is a graph showing olivetol production by *S. cerevisiae* strains expressing OLS candidate enzymes. Peak areas obtained via LC/MS quantification were normalized to an internal standard for olivetol. Normalized peak areas were further normalized to a positive control strain (t339582) contained on each plate. As explained in Example 2 and in Table 6, OLS candidate enzymes within the library depicted in this Figure, and the positive control OLSs depicted in this Figure, were later found to contain a deletion in the nucleotide sequence encoding the OLS proteins, which led to the production of truncated proteins. Accordingly, all candidate OLS enzymes in this library, and the positive controls, were also tested independently in a new library containing only full-length OLS sequences, described in Example 3.

Figure 9:
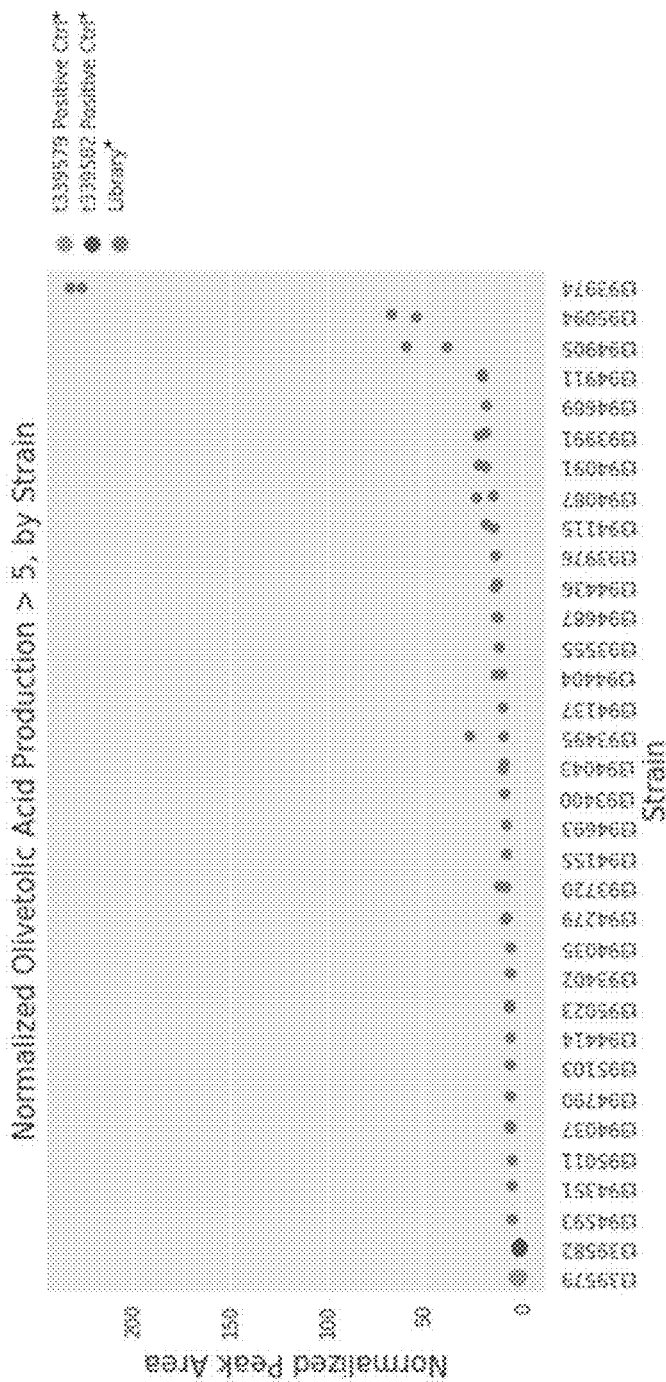

FIG. 9 is a graph showing olivetolic acid (OA) production by *S. cerevisiae* strains expressing OLS candidate enzymes. Peak areas obtained via LC/MS quantification were normalized to an internal standard for OA. Normalized peak areas were further normalized to a positive control strain (t339582) contained on each plate. As explained in Example 2 and in Table 6, OLS candidate enzymes within the library depicted in this Figure, and the positive control OLSs depicted in this Figure, were later found to contain a deletion in the nucleotide sequence encoding the OLS proteins, which led to the production of truncated proteins. Accordingly, all candidate OLS enzymes in this library, and the positive controls, were also tested independently in a new library containing only full-length OLS sequences, described in Example 3.

Figure 10:
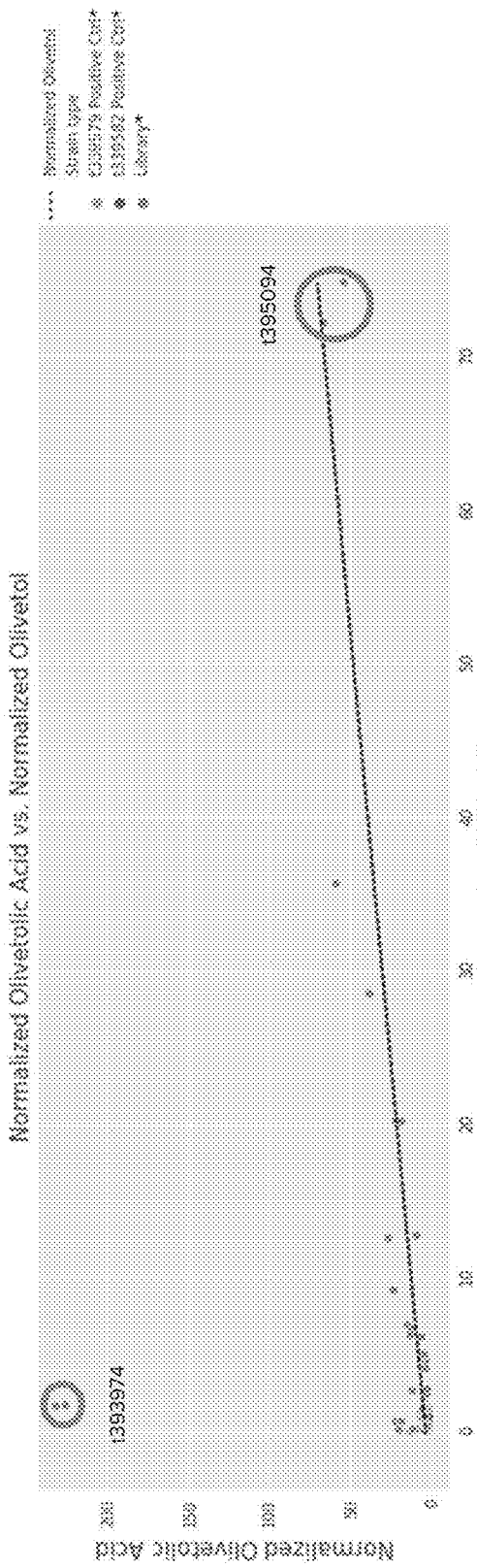

FIG. 10 is a graph showing normalized OA versus olivetol production by *S. cerevisiae* strains expressing OLS candidate enzymes. Peak areas obtained via LC/MS quantification for olivetol and OA were normalized to an internal standard for olivetol or OA, respectively. The regression line shown in FIG. 10 represents a 1:1 ratio of olivetol and olivetolic acid. Normalized peak areas were further normalized to positive control strain (t339582) contained on each plate. The strain t395094 demonstrated significantly increased olivetol production compared to the positive controls, while the strain t393974 showed enhanced production of OA over the positive control strains. The enhanced production of OA over olivetol by t393974 suggests that this enzyme possesses bifunctional PKS-PKC activity. As explained in Example 2 and in Table 6, OLS candidate enzymes within the library depicted in this Figure, and the positive control OLSs depicted in this Figure, were later found to contain a deletion in the nucleotide sequence encoding the OLS proteins, which led to the production of truncated proteins. Accordingly, all candidate OLS enzymes in this library, and the positive controls, were also tested independently in a new library containing only full-length OLS sequences, described in Example 3.

Figure 11B:
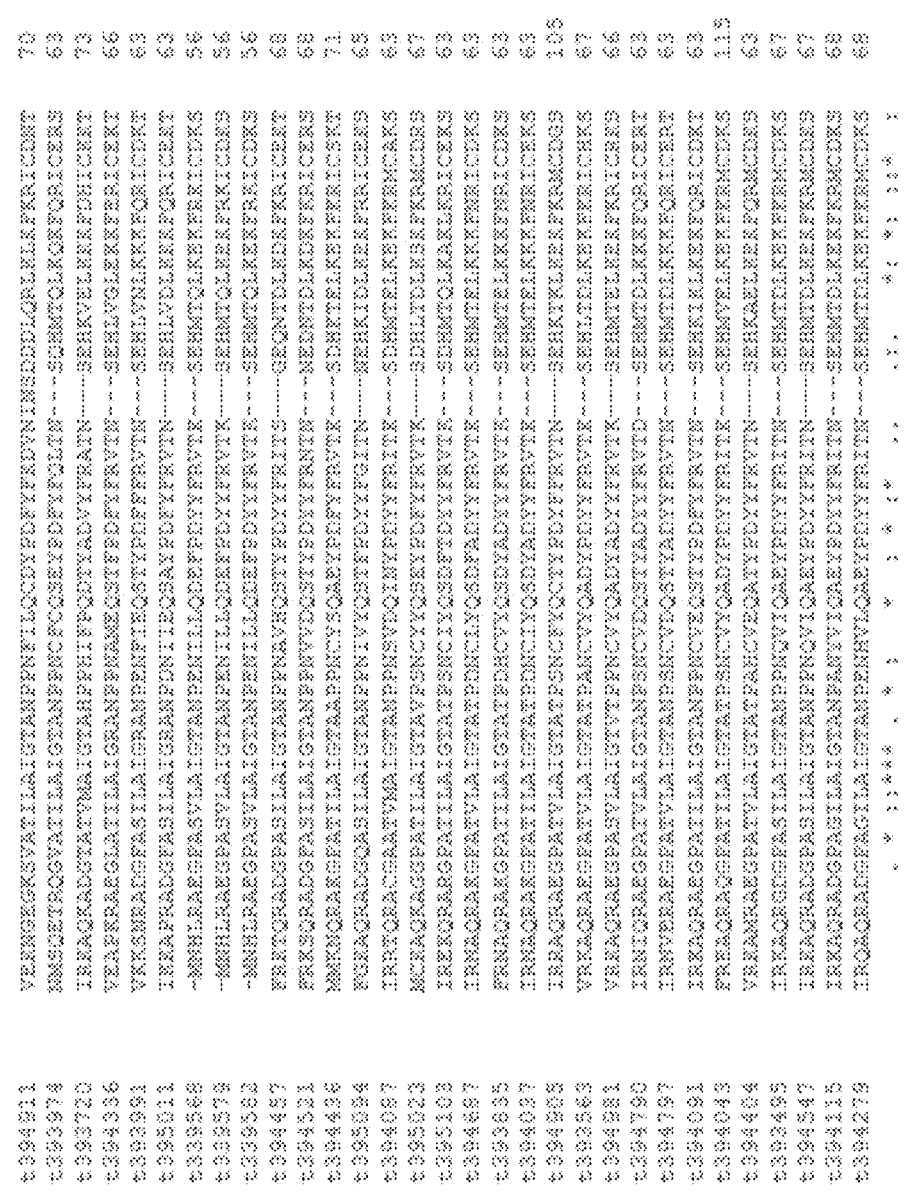
Figure 11C:
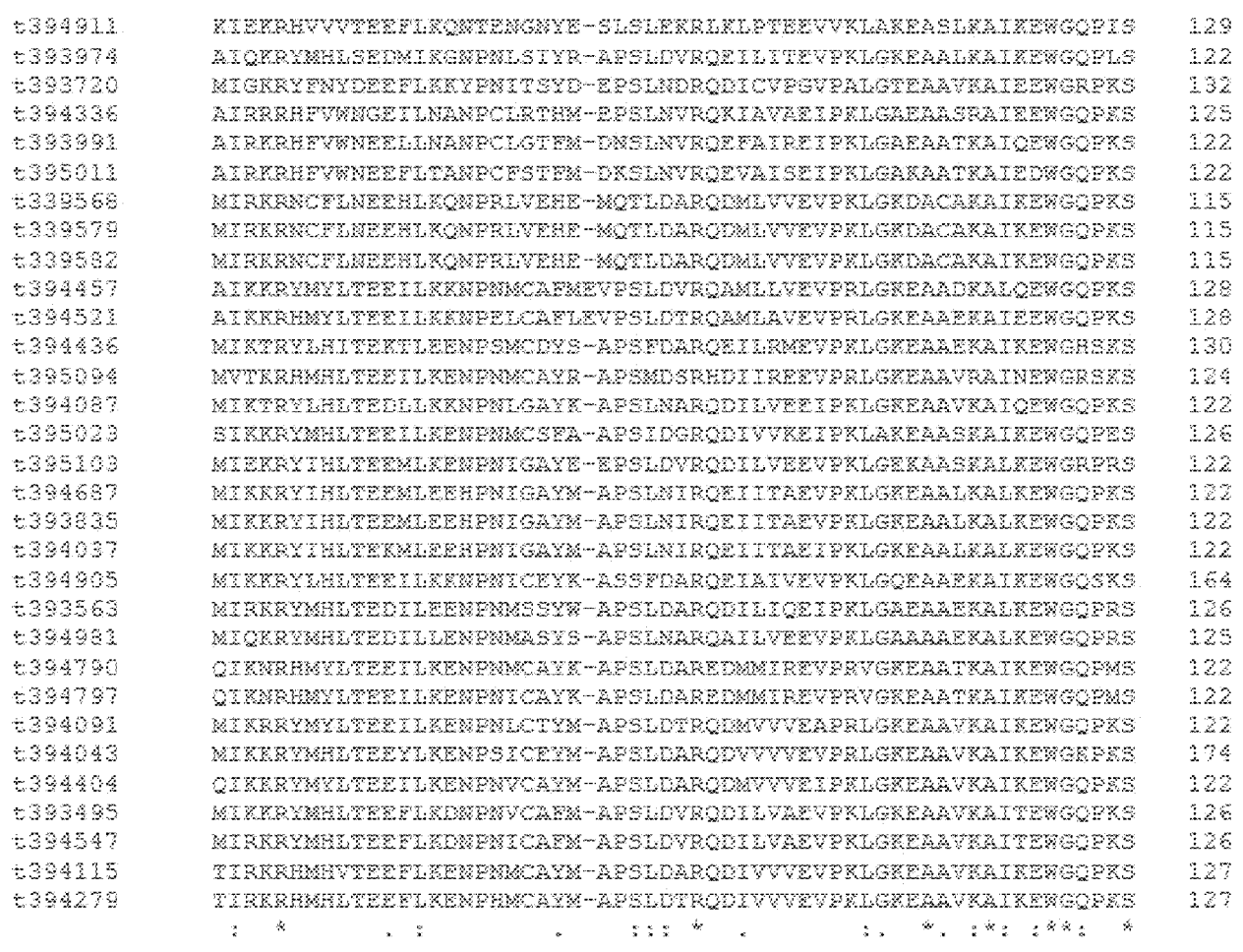
Figure 11D:
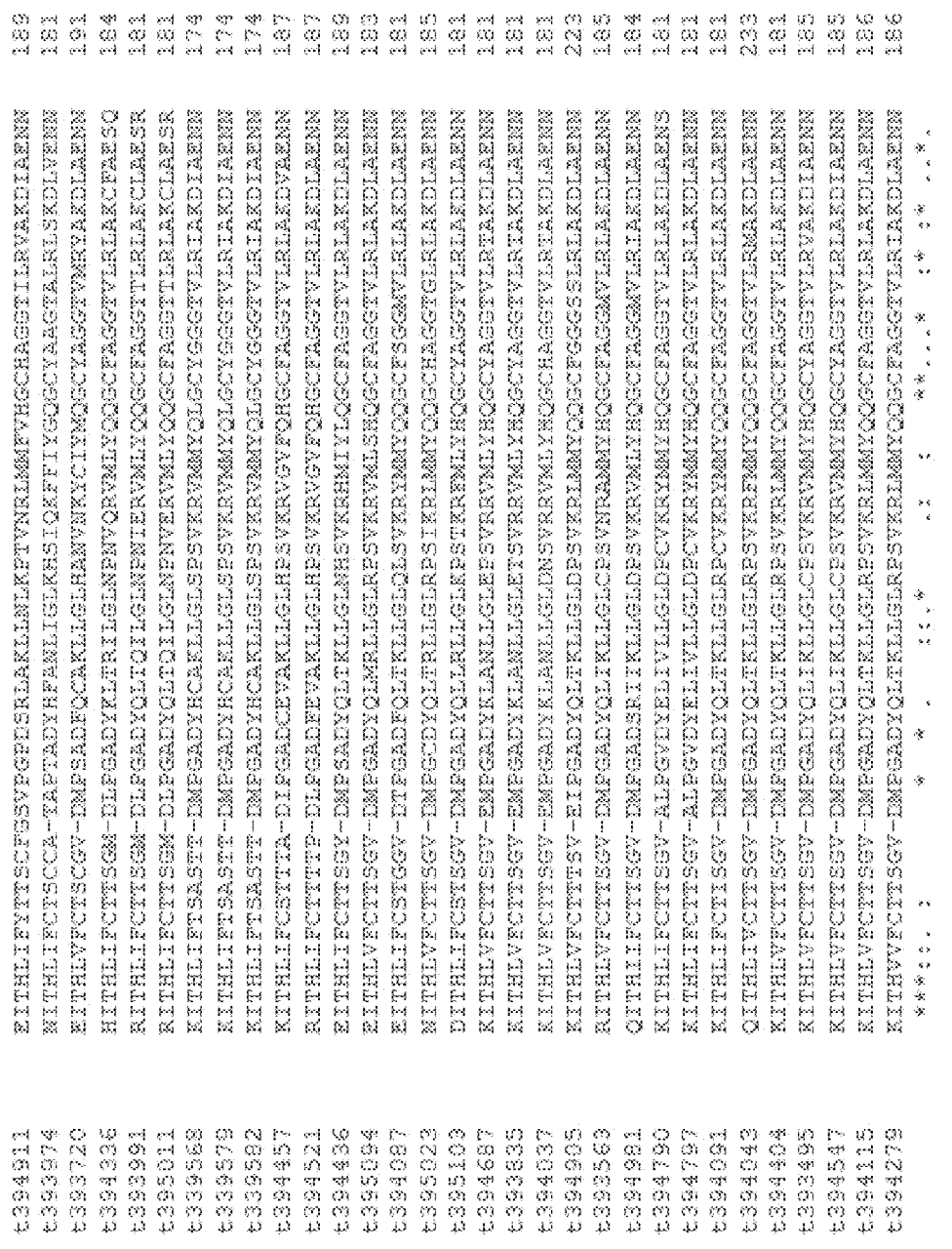
Figure 11E:
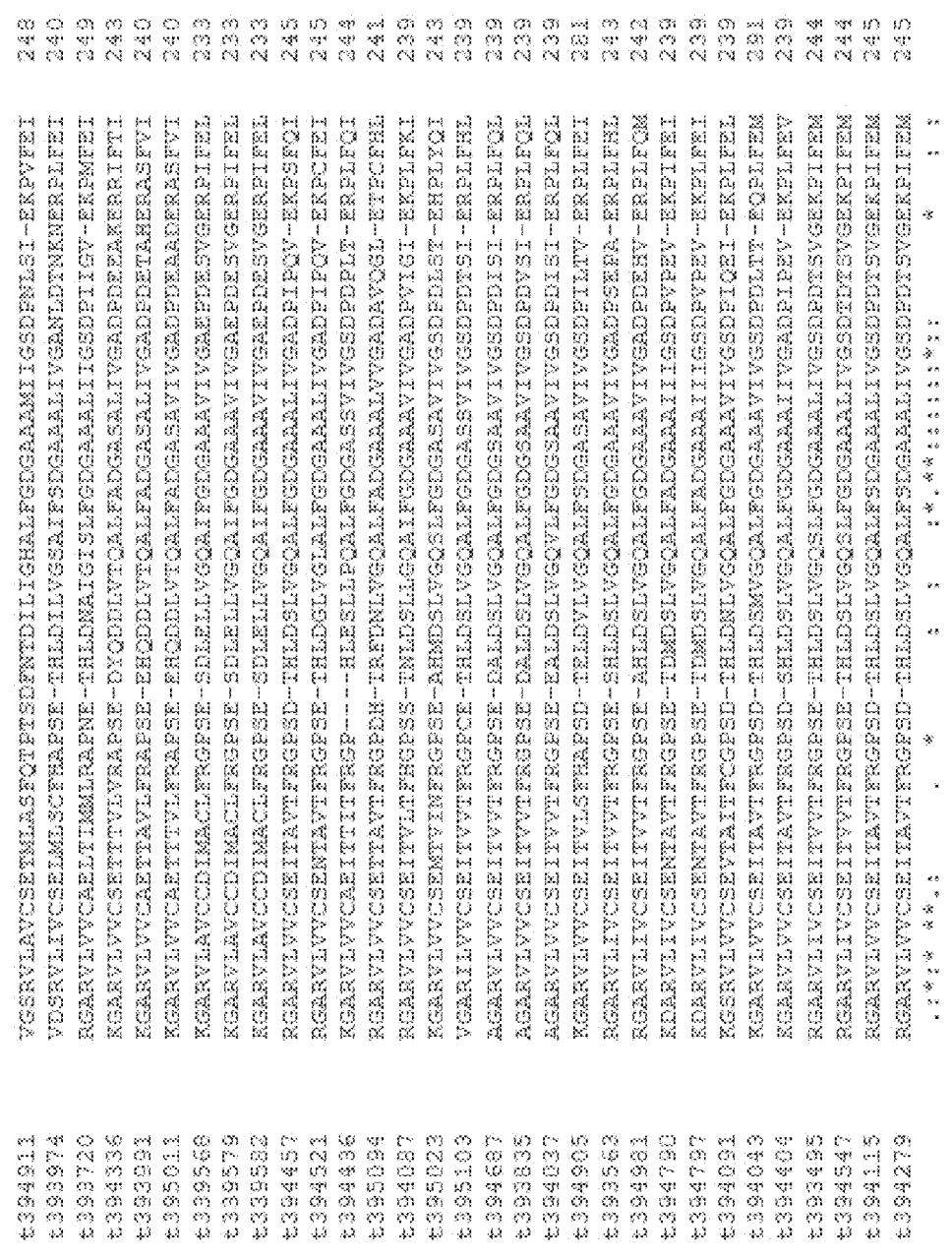
Figure 11F:
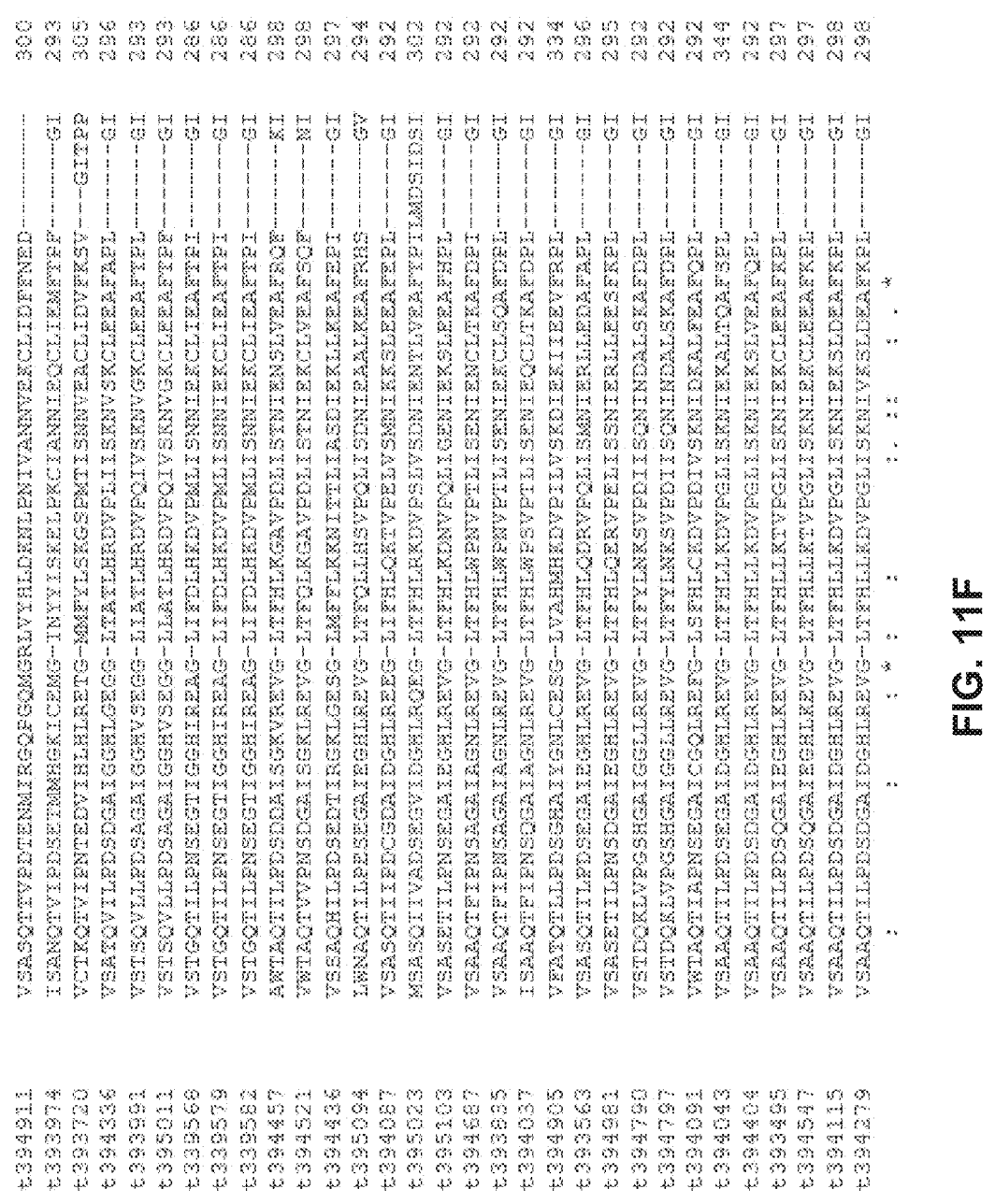
Figure 11G:
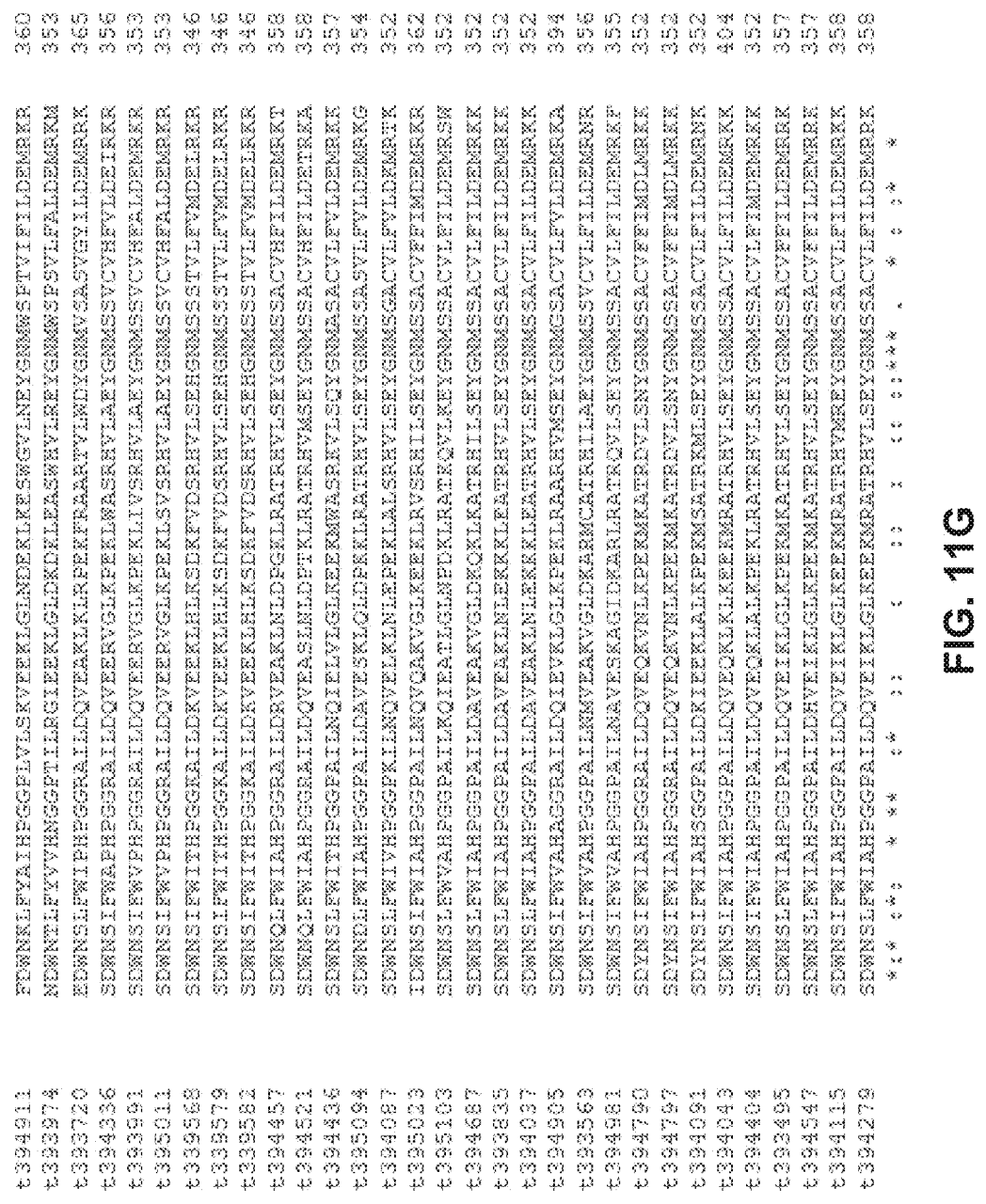

FIGS. 11A-11II show a sequence alignment of olivetol synthases (OLSs). An alignment of t394911 (SEQ ID NO: 28), t393974 (SEQ ID NO: 6), t393720 (SEQ ID NO: 27), t394336 (SEQ ID NO: 8), t393991 (SEQ ID NO: 7), t395011 (SEQ ID NO: 15), t339568 (SEQ ID NO: 5), t339579 (SEQ ID NO: 30), t339582 (SEQ ID NO: 31), t394457 (SEQ ID NO: 10), t394521 (SEQ ID NO: 11), t394436 (SEQ ID NO: 26), t395094 (SEQ ID NO: 17), t394087 (SEQ ID NO: 1), t395023 (SEQ ID NO: 29), t395103 (SEQ ID NO: 18), t394687 (SEQ ID NO: 2), t393835 (SEQ ID NO: 19), t394037 (SEQ ID NO: 22), t394905 (SEQ ID NO: 13), t393563 (SEQ ID NO: 4), t394981 (SEQ ID NO: 14), t394790 (SEQ ID NO: 12), t394797 (SEQ ID NO: 16), t394091 (SEQ ID NO: 21), t394043 (SEQ ID NO: 24), t394404 (SEQ ID NO: 25), t393495 (SEQ ID NO: 3), t394547 (SEQ ID NO: 9), t394115 (SEQ ID NO: 20), and t394279 (SEQ ID NO: 23) is shown. The sequence alignment was conducted using Clustal Omega. See, e.g., Chojnacki et al., *Nucleic Acids Res.* 2017 Jul. 3; 45(W1): W550-W553.

FIG. 12A-12B are graphs showing olivetol production (FIG. 12A) and olivetolic acid production (FIG. 12B) from *S. cerevisiae* strains expressing OLS candidate enzymes. Strains shown were determined to be hits from the primary screen of the library of OLS candidates screened in Example 3.

Figure 13:
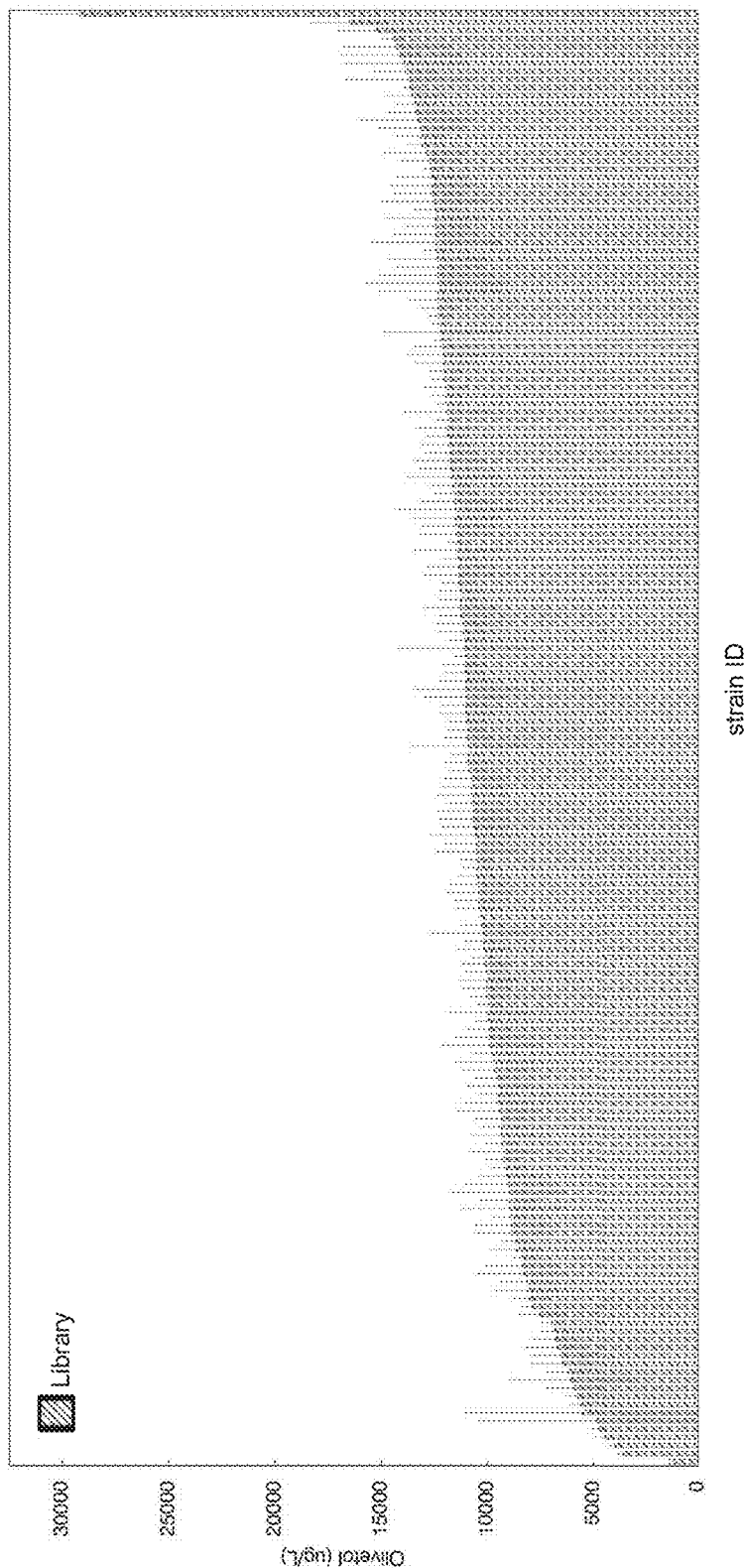

FIG. 13 is a graph showing olivetol production by *S. cerevisiae* strains expressing *C. sativa* OLS (CsOLS) point-mutant variants. Concentrations of olivetol in µg/L were determined via LC/MS quantification. The strain t405417 (having a T335C point mutation relative to the CsOLS set forth in SEQ ID NO: 5) demonstrated the highest olivetol production. Error bars represent the standard deviation of 4 independent measurements.

Figure 14A:
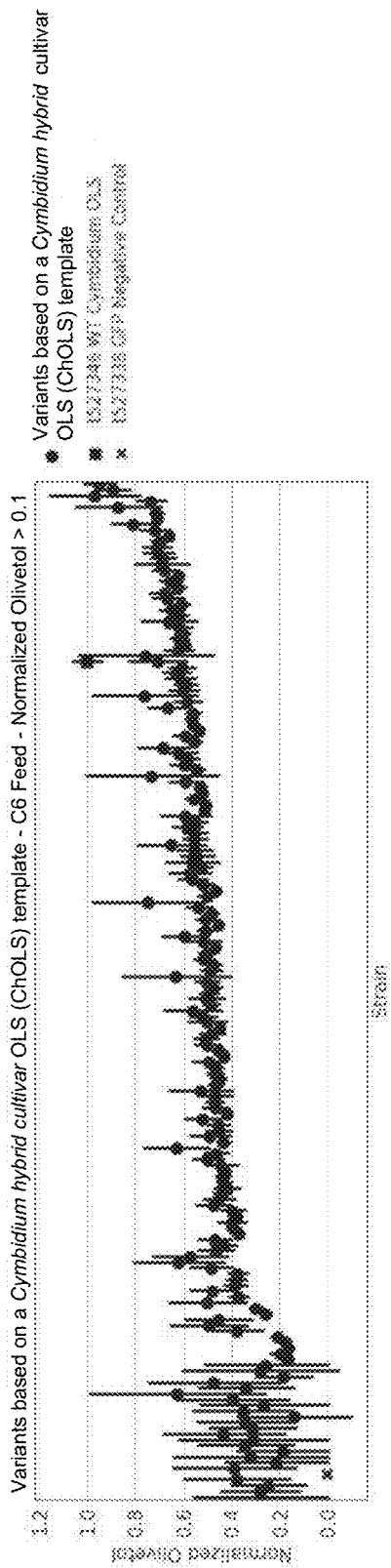
Figure 14B:
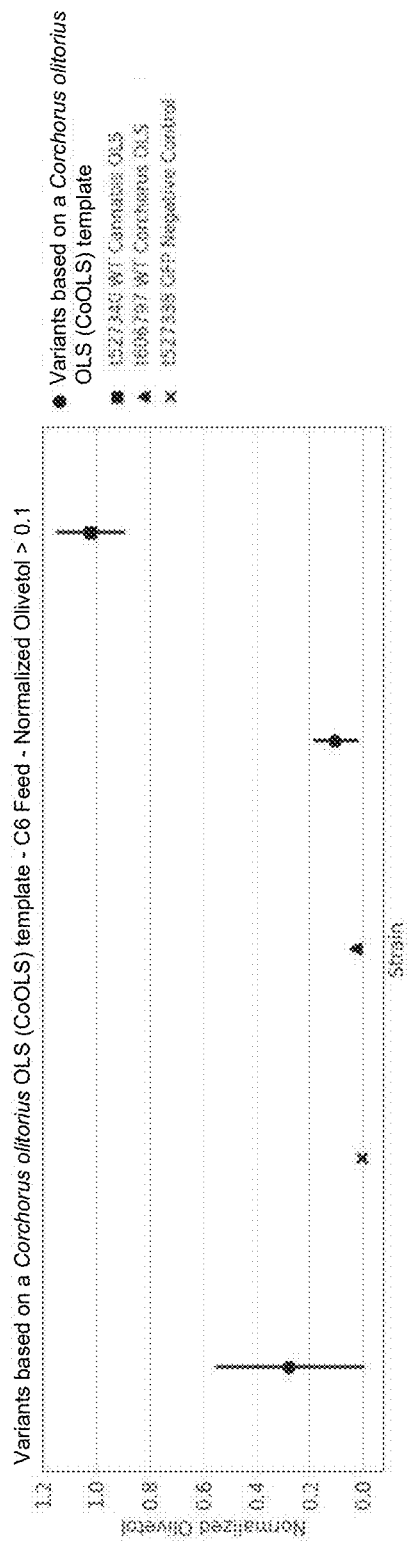

FIGS. 14A-14B are graphs showing olivetol production from *S. cerevisiae* strains expressing single point mutation and multiple point mutation variants based on a Cymbidium hybrid cultivar OLS template (ChOLS) (FIG. 14A) and a *Corchorus olitorius* OLS (CoOLS) template (FIG. 14B). Strains shown were screened in a secondary screen as described in Example 5. Olivetol titers were normalized to the mean olivetol titer produced by the positive control strain t527346 (FIG. 14A), and t606797 (FIG. 14B).

Figure 15:
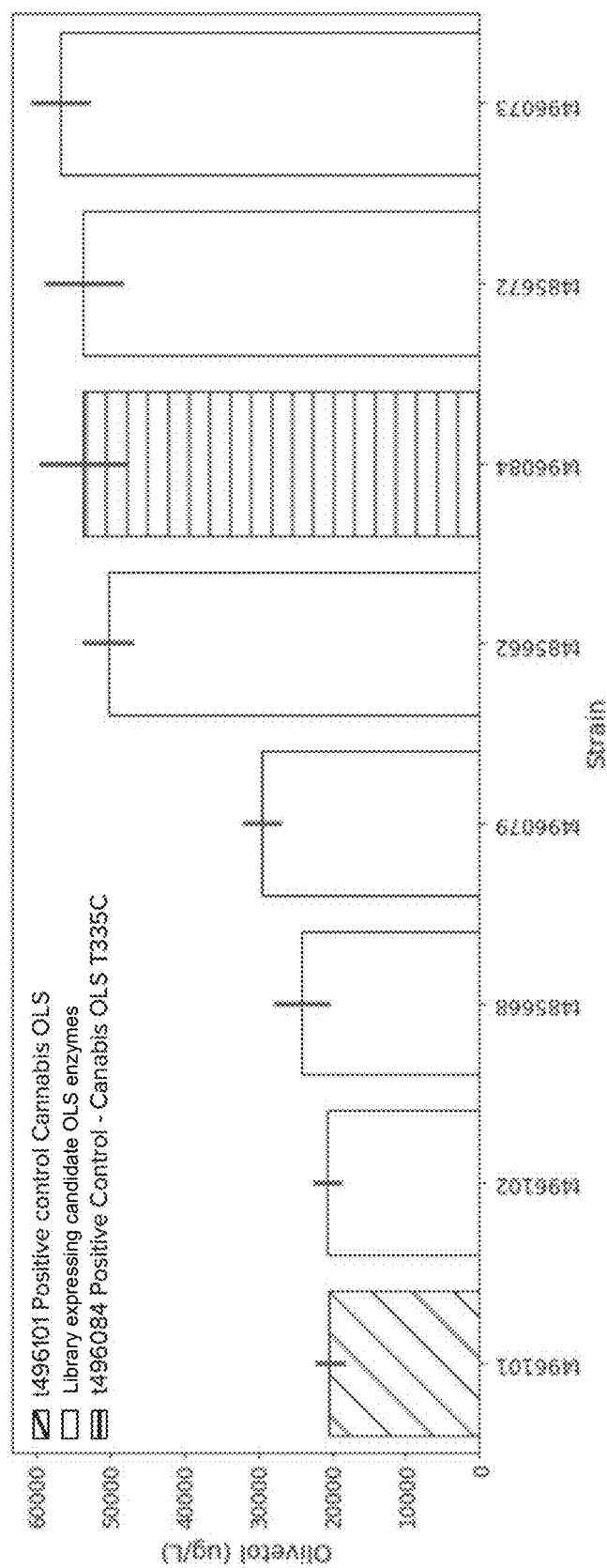

FIG. 15 is a graph showing olivetol production by a prototrophic *S. cerevisiae* strain expressing candidate OLS enzymes. Concentrations of olivetol in µg/L were determined via LC/MS quantification. Performance of OLS candidate enzymes exhibiting higher olivetol production than *C. sativa* OLS positive controls is shown. The strains t485662, t485672, and t496073 demonstrated comparable olivetol production to the CsOLS T335C point-mutant positive control.

Figure 16:
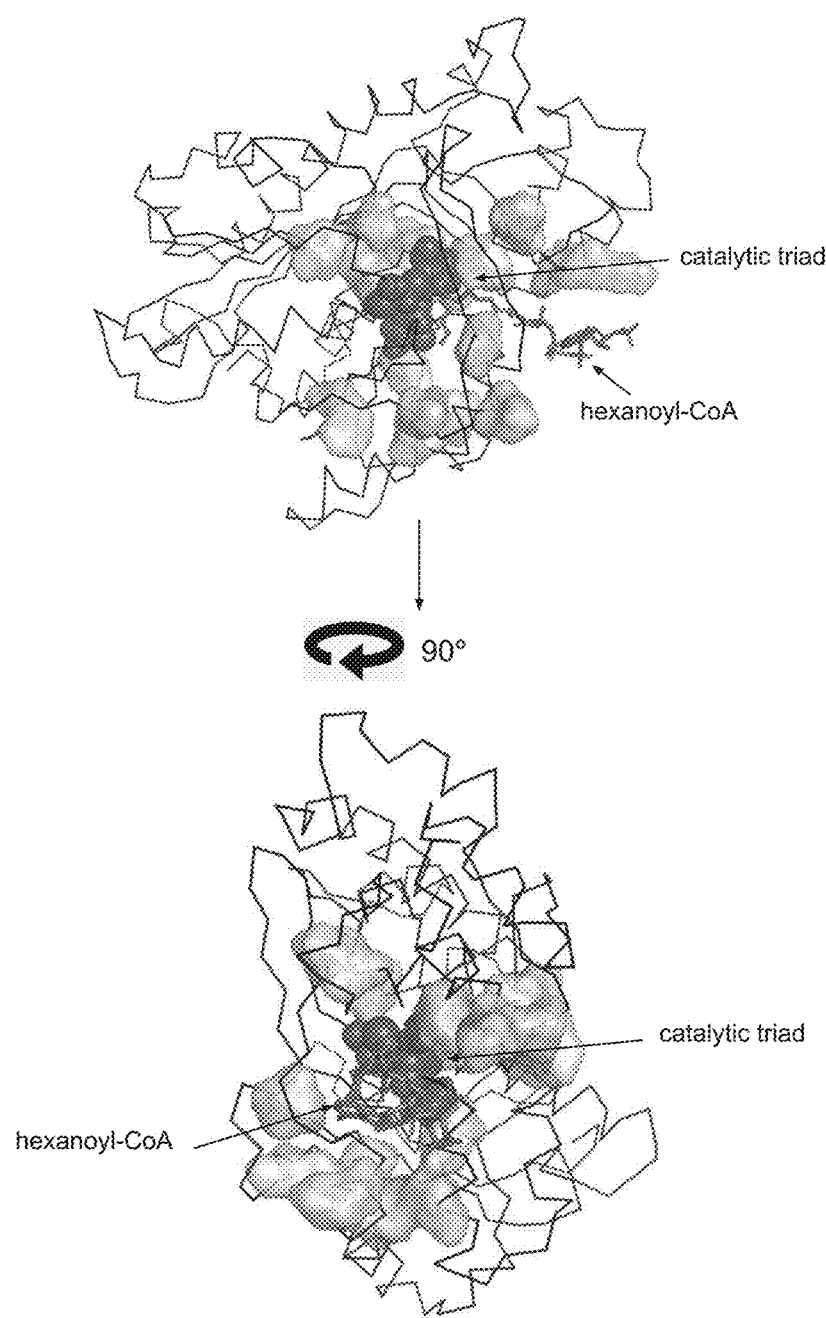

FIG. 16 is a three-dimensional homology model showing residues within about 8 angstroms of any of the residues within the catalytic triad of the *C. sativa* OLS comprising SEQ ID NO: 5 and/or within about 8 angstroms of a docked substrate within the *C. sativa* OLS comprising SEQ ID NO: 5. Only residues at which an amino acid substitution resulted in production of at least 10 mg/L olivetol are shown with their electron clouds in light gray. The active site was defined to include a docked molecule of hexanoyl-CoA (OLS substrate) plus the catalytic triad. The top model was rotated 90° to produce the bottom model.

Figure 17:
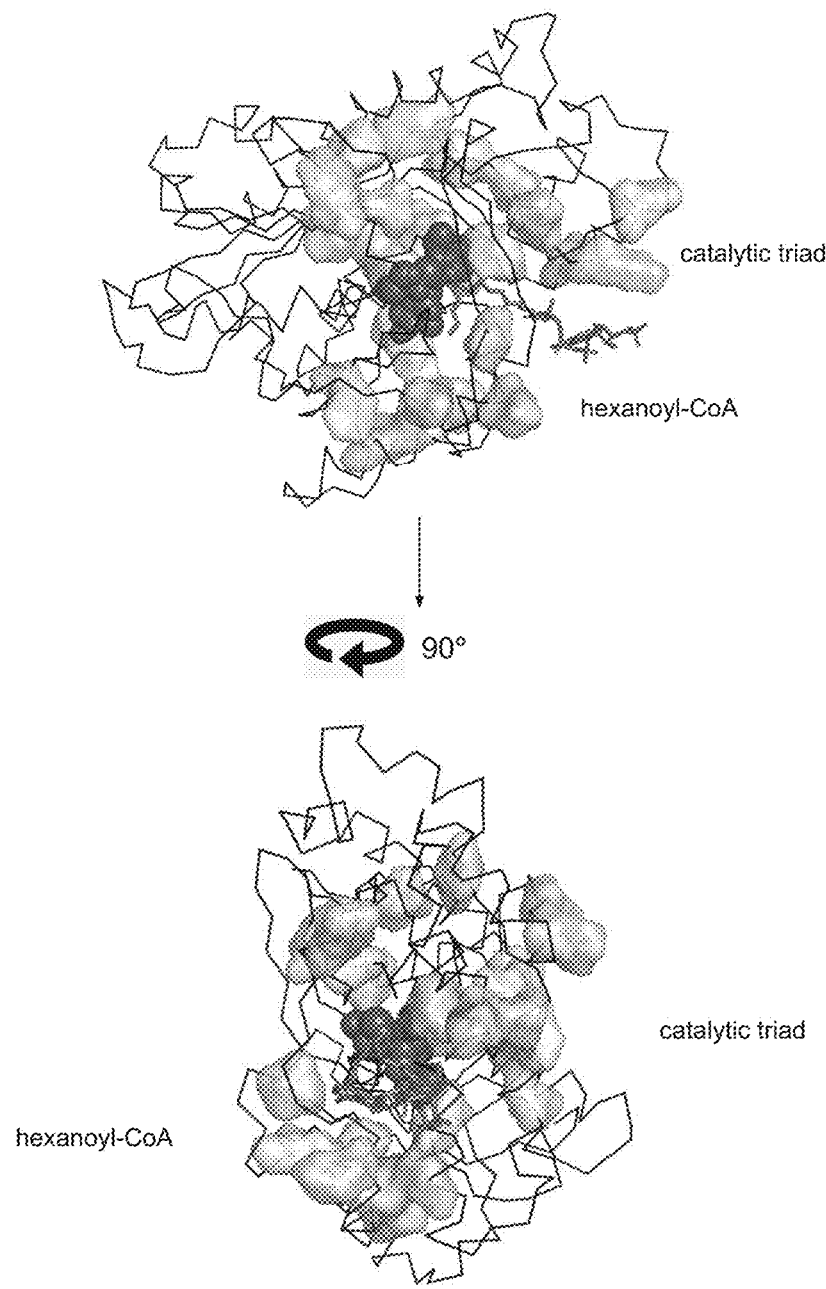

FIG. 17 is a three-dimensional homology model showing residues within about 12 angstroms of any of the residues within the catalytic triad of the *C. sativa* OLS comprising SEQ ID NO: 5 and/or within about 12 angstroms of a docked substrate within the *C. sativa* OLS comprising SEQ ID NO: 5. Only residues at which an amino acid substitution resulted in production of at least 10 mg/L olivetol are shown with their electron clouds. The active site was defined to include a docked molecule of hexanoyl-CoA (OLS substrate) plus the catalytic triad. The top model was rotated 90° to produce the bottom model.

DETAILED DESCRIPTION

This disclosure provides methods for production of cannabinoids and cannabinoid precursors from fatty acid substrates using genetically modified host cells. Methods include heterologous expression of enzymes including acyl activating enzymes (AAE) and polyketide synthase enzymes (PKS) such as olivetol synthase enzymes (OLS). The disclosure describes identification of AAE and OLS enzymes that can be functionally expressed in eukaryotic (e.g., *S. cerevisiae*) and prokaryotic (*E. coli*) host cells such as *S. cerevisiae* and *E. coli*. As demonstrated in Example 1, novel AAE enzymes were identified that are capable of using hexanoate and butyrate as substrates to produce cannabinoid precursors. As demonstrated in Examples 2-3, novel OLS enzymes were identified that are capable of producing olivetol and olivetolic acid. Examples 4-6 further demonstrate enhanced production of olivetol and/or olivetolic acid by protein engineering of OLS enzymes. The novel enzymes described in this disclosure may be useful in increasing the efficiency and purity of cannabinoid production.

Definitions

While the following terms are believed to be well understood by one of ordinary skill in the art, the following definitions are set forth to facilitate explanation of the disclosed subject matter.

The term "a" or "an" refers to one or more of an entity, i.e., can identify a referent as plural. Thus, the terms "a" or "an," "one or more" and "at least one" are used interchangeably in this application. In addition, reference to "an element" by the indefinite article "a" or "an" does not exclude the possibility that more than one of the elements is present, unless the context clearly requires that there is one and only one of the elements.

The terms "microorganism" or "microbe" should be taken broadly. These terms are used interchangeably and include, but are not limited to, the two prokaryotic domains, Bacteria and Archaea, as well as certain eukaryotic fungi and protists. In some embodiments, the disclosure may refer to the "microorganisms" or "microbes" of lists/tables and figures present in the disclosure. This characterization can refer to not only the identified taxonomic genera of the tables and figures, but also the identified taxonomic species, as well as the various novel and newly identified or designed strains of any organism in the tables or figures. The same characterization holds true for the recitation of these terms in other parts of the specification, such as in the Examples.

The term "prokaryotes" is recognized in the art and refers to cells that contain no nucleus or other cell organelles. The prokaryotes are generally classified in one of two domains, the Bacteria and the Archaea.

"Bacteria" or "eubacteria" refers to a domain of prokaryotic organisms. Bacteria include at least 11 distinct groups as follows: (1) Gram-positive (gram+) bacteria, of which there are two major subdivisions: (a) high G+C group (Actinomycetes, Mycobacteria, *Micrococcus*, others) and (b) low G+C group (*Bacillus, Clostridia, Lactobacillus*, Staphylococci, Streptococci, Mycoplasmas); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) Spirochetes and related species; (5) Planctomyces; (6) *Bacteroides*, Flavobacteria; (7) *Chlamydia*; (8) Green sulfur bacteria; (9) Green non-sulfur bacteria (also anaerobic phototrophs); (10) Radioresistant micrococci and relatives; and (11) *Thermotoga* and Thermosipho thermophiles.

The term "Archaea" refers to a taxonomic classification of prokaryotic organisms with certain properties that make them distinct from Bacteria in physiology and phylogeny.

The term "*Cannabis*" refers to a genus in the family Cannabaceae. *Cannabis* is a dioecious plant. Glandular structures located on female flowers of *Cannabis*, called trichomes, accumulate relatively high amounts of a class of terpeno-phenolic compounds known as phytocannabinoids (described in further detail below). *Cannabis* has conventionally been cultivated for production of fibre and seed (commonly referred to as "hemp-type"), or for production of intoxicants (commonly referred to as "drug-type"). In drug-type *Cannabis*, the trichomes contain relatively high amounts of tetrahydrocannabinolic acid (THCA), which can convert to tetrahydrocannabinol (THC) via a decarboxylation reaction, for example upon combustion of dried *Cannabis* flowers, to provide an intoxicating effect. Drug-type *Cannabis* often contains other cannabinoids in lesser amounts. In contrast, hemp-type *Cannabis* contains relatively low concentrations of THCA, often less than 0.3% THC by dry weight, accounting for the ability of THCA to convert to THC. Hemp-type *Cannabis* may contain non-THC and non-THCA cannabinoids, such as cannabidiolic acid (CBDA), cannabidiol (CBD), and other cannabinoids. Presently, there is a lack of consensus regarding the taxonomic organization of the species within the genus. Unless context dictates otherwise, the term "*Cannabis*" is intended to include all putative species within the genus, such as, without limitation, *Cannabis sativa, Cannabis indica*, and *Cannabis ruderalis* and without regard to whether the *Cannabis* is hemp-type or drug-type.

The term "cyclase activity" in reference to a polyketide synthase (PKS) enzyme (e.g., an olivetol synthase (OLS) enzyme) or a polyketide cyclase (PKC) enzyme (e.g., an olivetolic acid cyclase (OAC) enzyme), refers to the activity of catalyzing the cyclization of an oxo fatty acyl-CoA (e.g., 3,5,7-trioxododecanoyl-COA, 3,5,7-trioxodecanoyl-COA) to the corresponding intramolecular cyclization product (e.g., olivetolic acid, divarinic acid). In some embodiments, the PKS catalyzes the C2-C7 aldol condensation of an acyl-COA with three additional ketide moieties added thereto.

A "cytosolic" or "soluble" enzyme refers to an enzyme that is predominantly localized (or predicted to be localized) in the cytosol of a host cell.

A "eukaryote" is any organism whose cells contain a nucleus and other organelles enclosed within membranes. Eukaryotes belong to the taxon Eukarya or Eukaryota. The defining feature that sets eukaryotic cells apart from prokaryotic cells (i.e., bacteria and archaea) is that they have membrane-bound organelles, especially the nucleus, which contains the genetic material, and is enclosed by the nuclear envelope.

The term "host cell" refers to a cell that can be used to express a polynucleotide, such as a polynucleotide that encodes an enzyme used in biosynthesis of cannabinoids or cannabinoid precursors. The terms "genetically modified host cell," "recombinant host cell," and "recombinant strain" are used interchangeably and refer to host cells that have been genetically modified by, e.g., cloning and transformation methods, or by other methods known in the art (e.g., selective editing methods, such as CRISPR). Thus, the terms include a host cell (e.g., bacterial cell, yeast cell, fungal cell, insect cell, plant cell, mammalian cell, human cell, etc.) that has been genetically altered, modified, or engineered, so that it exhibits an altered, modified, or different genotype and/or phenotype, as compared to the naturally-occurring cell from which it was derived. It is understood that in some embodiments, the terms refer not only to the particular recombinant host cell in question, but also to the progeny or potential progeny of such a host cell.

The term "control host cell," or the term "control" when used in relation to a host cell, refers to an appropriate comparator host cell for determining the effect of a genetic modification or experimental treatment. In some embodiments, the control host cell is a wild type cell. In other embodiments, a control host cell is genetically identical to the genetically modified host cell, except for the genetic modification(s) differentiating the genetically modified or experimental treatment host cell. In some embodiments, the control host cell has been genetically modified to express a wild type or otherwise known variant of an enzyme being tested for activity in other test host cells.

The term "heterologous" with respect to a polynucleotide, such as a polynucleotide comprising a gene, is used interchangeably with the term "exogenous" and the term "recombinant" and refers to a polynucleotide that has been artificially supplied to a biological system, a polynucleotide that has been modified within a biological system, or a polynucleotide whose expression or regulation has been manipulated within a biological system. A heterologous polynucleotide that is introduced into or expressed in a host cell may be a polynucleotide that comes from a different organism or species than the host cell, or may be a synthetic polynucleotide, or may be a polynucleotide that is also endogenously expressed in the same organism or species as the host cell. For example, a polynucleotide that is endogenously expressed in a host cell may be considered heterologous when it is situated non-naturally in the host cell; expressed recombinantly in the host cell, either stably or transiently; modified within the host cell; selectively edited within the host cell; expressed in a copy number that differs from the naturally occurring copy number within the host cell; or expressed in a non-natural way within the host cell, such as by manipulating regulatory regions that control expression of the polynucleotide. In some embodiments, a heterologous polynucleotide is a polynucleotide that is endogenously expressed in a host cell but whose expression is driven by a promoter that does not naturally regulate expression of the polynucleotide. In other embodiments, a heterologous polynucleotide is a polynucleotide that is endogenously expressed in a host cell and whose expression is driven by a promoter that does naturally regulate expression of the polynucleotide, but the promoter or another regulatory region is modified. In some embodiments, the promoter is recombinantly activated or repressed. For example, gene-editing based techniques may be used to regulate expression of a polynucleotide, including an endogenous polynucleotide, from a promoter, including an endogenous promoter. See, e.g., Chavez et al., Nat Methods. 2016 July; 13(7): 563-567. A heterologous polynucleotide may comprise a wild-type sequence or a mutant sequence as compared with a reference polynucleotide sequence.

The term "at least a portion" or "at least a fragment" of a nucleic acid or polypeptide means a portion having the minimal size characteristics of such sequences, or any larger fragment of the full length molecule, up to and including the full length molecule. A fragment of a polynucleotide of the disclosure may encode a biologically active portion of an enzyme, such as a catalytic domain. A biologically active portion of a genetic regulatory element may comprise a portion or fragment of a full length genetic regulatory element and have the same type of activity as the full length genetic regulatory element, although the level of activity of the biologically active portion of the genetic regulatory element may vary compared to the level of activity of the full length genetic regulatory element.

A coding sequence and a regulatory sequence are said to be "operably joined" or "operably linked" when the coding sequence and the regulatory sequence are covalently linked and the expression or transcription of the coding sequence is under the influence or control of the regulatory sequence. If the coding sequence is to be translated into a functional protein, the coding sequence and the regulatory sequence are said to be operably joined if induction of a promoter in the 5' regulatory sequence results in transcription of the coding sequence and if the nature of the linkage between the coding sequence and the regulatory sequence does not (1) result in the introduction of a frame-shift mutation, (2) interfere with the ability of the promoter region to direct the transcription of the coding sequence, or (3) interfere with the ability of the corresponding RNA transcript to be translated into a protein.

The term "volumetric productivity" or "production rate" refers to the amount of product formed per volume of medium per unit of time. Volumetric productivity can be reported in gram per liter per hour (g/L/h).

The term "specific productivity" of a product refers to the rate of formation of the product normalized by unit volume or mass or biomass and has the physical dimension of a quantity of substance per unit time per unit mass or volume $[M \cdot T^{-1} \cdot M^{-1}$ or $M \cdot T^{-1} \cdot ^{-3}]$, where M is mass or moles, T is time, L is length].

The term "biomass specific productivity" refers to the specific productivity in gram product per gram of cell dry weight (CDW) per hour (g/g CDW/h) or in mmol of product per gram of cell dry weight (CDW) per hour (mmol/g CDW/h). Using the relation of CDW to OD600 for the given microorganism, specific productivity can also be expressed as gram product per liter culture medium per optical density of the culture broth at 600 nm (OD) per hour (g/L/h/OD). Also, if the elemental composition of the biomass is known, biomass specific productivity can be expressed in mmol of product per C-mole (carbon mole) of biomass per hour (mmol/C-mol/h).

The term "yield" refers to the amount of product obtained per unit weight of a certain substrate and may be expressed as g product per g substrate (g/g) or moles of product per mole of substrate (mol/mol). Yield may also be expressed as a percentage of the theoretical yield. "Theoretical yield" is defined as the maximum amount of product that can be generated per a given amount of substrate as dictated by the stoichiometry of the metabolic pathway used to make the product and may be expressed as g product per g substrate (g/g) or moles of product per mole of substrate (mol/mol).

The term "titer" refers to the strength of a solution or the concentration of a substance in solution. For example, the titer of a product of interest (e.g., small molecule, peptide, synthetic compound, fuel, alcohol, etc.) in a fermentation broth is described as g of product of interest in solution per liter of fermentation broth or cell-free broth (g/L) or as g of product of interest in solution per kg of fermentation broth or cell-free broth (g/Kg).

The term "total titer" refers to the sum of all products of interest produced in a process, including but not limited to the products of interest in solution, the products of interest in gas phase if applicable, and any products of interest removed from the process and recovered relative to the initial volume in the process or the operating volume in the process. For example, the total titer of products of interest (e.g., small molecule, peptide, synthetic compound, fuel, alcohol, etc.) in a fermentation broth is described as g of products of interest in solution per liter of fermentation broth or cell-free broth (g/L) or as g of products of interest in solution per kg of fermentation broth or cell-free broth (g/Kg).

The term "amino acid" refers to organic compounds that comprise an amino group, —NH2, and a carboxyl group, —COOH. The term "amino acid" includes both naturally occurring and unnatural amino acids. Nomenclature for the twenty common amino acids is as follows: alanine (ala or A); arginine (arg or R); asparagine (asn or N); aspartic acid (asp or D); cysteine (cys or C); glutamine (gln or Q); glutamic acid (glu or E); glycine (gly or G); histidine (his or H); isoleucine (ile or I); leucine (leu or L); lysine (lys or K); methionine (met or M); phenylalanine (phe or F); proline (pro or P); serine (ser or S); threonine (thr or T); tryptophan (trp or W); tyrosine (tyr or Y); and valine (val or V). Non-limiting examples of unnatural amino acids include homo-amino acids, proline and pyruvic acid derivatives, 3-substituted alanine derivatives, glycine derivatives, ring-substituted phenylalanine derivatives, ring-substituted tyrosine derivatives, linear core amino acids, amino acids with protecting groups including Fmoc, Boc, and Cbz, β-amino acids (β3 and β2), and N-methyl amino acids.

The term "aliphatic" refers to alkyl, alkenyl, alkynyl, and carbocyclic groups. Likewise, the term "heteroaliphatic" refers to heteroalkyl, heteroalkenyl, heteroalkynyl, and heterocyclic groups.

The term "alkyl" refers to a radical of, or a substituent that is, a straight-chain or branched saturated hydrocarbon group having from 1 to 20 carbon atoms ("C1-20 alkyl"). In certain embodiments, the term "alkyl" refers to a radical of, or a substituent that is, a straight-chain or branched saturated hydrocarbon group having from 1 to 10 carbon atoms ("$C_{1-10}$ alkyl"). In some embodiments, an alkyl group has 1 to 9 carbon atoms ("$C_{1-9}$ alkyl"). In some embodiments, an alkyl group has 1 to 8 carbon atoms ("$C_{1-8}$ alkyl"). In some embodiments, an alkyl group has 1 to 7 carbon atoms ("$C_{1-7}$ alkyl"). In some embodiments, an alkyl group has 1 to 6 carbon atoms ("$C_{1-6}$ alkyl"). In some embodiments, an alkyl group has 2 to 6 carbon atoms ("$C_{2-6}$ alkyl"). In some embodiments, an alkyl group has 3 to 5 carbon atoms ("$C_{3-5}$ alkyl"). In some embodiments, an alkyl group has 5 carbon atoms ("$C_5$ alkyl"). In some embodiments, the alkyl group has 3 carbon atoms ("C3 alkyl"). In some embodiments, an alkyl group has 1 to 5 carbon atoms ("$C_{1-5}$ alkyl"). In some embodiments, an alkyl group has 1 to 4 carbon atoms ("$C_{1-4}$ alkyl"). In some embodiments, an alkyl group has 1 to 3 carbon atoms ("$C_{1-3}$ alkyl"). In some embodiments, an alkyl group has 1 to 2 carbon atoms ("$C_{1-2}$ alkyl"). In some embodiments, an alkyl group has 1 carbon atom ("$C_1$ alkyl").

Examples of $C_{1-6}$ alkyl groups include methyl ($C_1$), ethyl ($C_2$), propyl ($C_3$) (e.g., n-propyl, isopropyl), butyl ($C_4$) (e.g., n-butyl, tert-butyl, sec-butyl, iso-butyl), pentyl ($C_5$) (e.g., n-pentyl, 3-pentanyl, amyl, neopentyl, 3-methyl-2-butanyl, tertiary amyl), and hexyl ($C_6$) (e.g., n-hexyl). Additional examples of alkyl groups include n-heptyl ($C_7$), n-octyl ($C_8$), and the like. Unless otherwise specified, each instance of an alkyl group is independently unsubstituted (an "unsubstituted alkyl") or substituted (a "substituted alkyl") with one or more substituents (e.g., halogen, such as F). In certain embodiments, the alkyl group is an unsubstituted $C_{1-10}$ alkyl (such as unsubstituted $C_{1-6}$ alkyl, e.g., —CH$_3$ (Me), unsubstituted ethyl (Et), unsubstituted propyl (Pr, e.g., unsubstituted n-propyl (n-Pr), unsubstituted isopropyl (i-Pr)), unsubstituted butyl (Bu, e.g., unsubstituted n-butyl (n-Bu), unsubstituted tert-butyl (tert-Bu or t-Bu), unsubstituted sec-butyl (sec-Bu), unsubstituted isobutyl (i-Bu)). In certain embodiments, the alkyl group is a substituted $C_{1-10}$ alkyl (such as substituted $C_{1-6}$ alkyl, e.g., —CF$_3$, benzyl).

The term "acyl" refers to a group having the general formula —C(=O)R$^{X1}$, —C(=O)OR$^{X1}$, —C(=O)—O—C(=O)R$^{X1}$, —C(=O)SR$^{X1}$, —C(=O)N(R$^{X1}$)$_2$, —C(=S)R$^{X1}$, —C(=S)N(R$^{X1}$)$_2$, and —C(=S)S(R$^{X1}$), —C(=NR$^{X1}$)R$^{X1}$, —C(=NR$^{X1}$)OR$^{X1}$, —C(=NR$^{X1}$)SR$^{X1}$, and —C(=NR$^{X1}$)N(R$^{X1}$)$_2$, wherein R$^{X1}$ is hydrogen; halogen; substituted or unsubstituted hydroxyl; substituted or unsubstituted thiol; substituted or unsubstituted amino; substituted or unsubstituted acyl, cyclic or acyclic, substituted or unsubstituted, branched or unbranched aliphatic; cyclic or acyclic, substituted or unsubstituted, branched or unbranched heteroaliphatic; cyclic or acyclic, substituted or unsubstituted, branched or unbranched alkyl; cyclic or acyclic, substituted or unsubstituted, branched or unbranched alkenyl; substituted or unsubstituted alkynyl; substituted or unsubstituted aryl, substituted or unsubstituted heteroaryl, aliphaticoxy, heteroaliphaticoxy, alkyloxy, heteroalkyloxy, aryloxy, heteroaryloxy, aliphaticthioxy, heteroaliphaticthioxy, alkylthioxy, heteroalkylthioxy, arylthioxy, heteroarylthioxy, mono- or di-aliphaticamino, mono- or di-heteroaliphaticamino, mono- or di-alkylamino, mono- or di-heteroalkylamino, mono- or di-arylamino, or mono- or di-heteroarylamino; or two R$^{X1}$ groups taken together form a 5- to 6-membered heterocyclic ring. Exemplary acyl groups include aldehydes (—CHO), carboxylic acids (—CO$_2$H), ketones, acyl halides, esters, amides, imines, carbonates, carbamates, and ureas. Acyl substituents include, but are not limited to, any of the substituents described in this application that result in the formation of a stable moiety (e.g., aliphatic, alkyl, alkenyl, alkynyl, heteroaliphatic, heterocyclic, aryl, heteroaryl, acyl, oxo, imino, thiooxo, cyano, isocyano, amino, azido, nitro, hydroxyl, thiol, halo, aliphaticamino, heteroaliphaticamino, alkylamino, heteroalkylamino, arylamino, heteroarylamino, alkylaryl, arylalkyl, aliphaticoxy, heteroaliphaticoxy, alkyloxy, heteroalkyloxy, aryloxy, heteroaryloxy, aliphaticthioxy, heteroaliphaticthioxy, alkylthioxy, heteroalkylthioxy, arylthioxy, heteroarylthioxy, acyloxy, and the like, each of which may or may not be further substituted).

"Alkenyl" refers to a radical of, or a substituent that is, a straight-chain or branched hydrocarbon group having from 2 to 20 carbon atoms, one or more carbon-carbon double bonds, and no triple bonds ("$C_{2-20}$ alkenyl"). In some embodiments, an alkenyl group has 2 to 10 carbon atoms ("$C_{2-10}$ alkenyl"). In some embodiments, an alkenyl group has 2 to 9 carbon atoms ("$C_{2-9}$ alkenyl"). In some embodiments, an alkenyl group has 2 to 8 carbon atoms ("$C_{2-8}$ alkenyl"). In some embodiments, an alkenyl group has 2 to 7 carbon atoms ("$C_{2-7}$ alkenyl"). In some embodiments, an alkenyl group has 2 to 6 carbon atoms ("$C_{2-6}$ alkenyl"). In some embodiments, an alkenyl group has 2 to 5 carbon atoms ("$C_{2-5}$ alkenyl"). In some embodiments, an alkenyl group has 2 to 4 carbon atoms ("$C_{2-4}$ alkenyl"). In some embodiments, an alkenyl group has 2 to 3 carbon atoms ("$C_{2-3}$ alkenyl"). In some embodiments, an alkenyl group has 2 carbon atoms ("$C_2$ alkenyl"). The one or more carbon-carbon double bonds can be internal (such as in 2-butenyl) or terminal (such as in 1-butenyl). Examples of C2-4 alkenyl groups include ethenyl ($C_2$), 1-propenyl ($C_3$), 2-propenyl ($C_3$), 1-butenyl ($C_4$), 2-butenyl ($C_4$), butadienyl ($C_4$), and the like. Examples of $C_{2-6}$ alkenyl groups include the aforementioned $C_{2-4}$ alkenyl groups as well as pentenyl ($C_5$), pentadienyl ($C_5$), hexenyl ($C_6$), and the like. Additional examples of alkenyl include heptenyl ($C_7$), octenyl ($C_8$), octatrienyl ($C_8$), and the like. Unless otherwise specified, each instance of an alkenyl group is independently optionally substituted, i.e., unsubstituted (an "unsubstituted alkenyl") or substituted (a "substituted alkenyl") with one or more substituents. In certain embodiments, the alkenyl group is unsubstituted $C_{2-10}$ alkenyl. In certain embodiments, the alkenyl group is substituted $C_{2-10}$ alkenyl.

"Alkynyl" refers to a radical of, or a substituent that is, a straight-chain or branched hydrocarbon group having from 2 to 20 carbon atoms, one or more carbon-carbon triple bonds, and optionally one or more double bonds ("$C_{2-20}$ alkynyl"). In some embodiments, an alkynyl group has 2 to 10 carbon atoms ("$C_{2-10}$ alkynyl"). In some embodiments, an alkynyl group has 2 to 9 carbon atoms ("$C_{2-9}$ alkynyl"). In some embodiments, an alkynyl group has 2 to 8 carbon atoms ("$C_{2-8}$ alkynyl"). In some embodiments, an alkynyl group has 2 to 7 carbon atoms ("$C_{2-7}$ alkynyl"). In some embodiments, an alkynyl group has 2 to 6 carbon atoms ("$C_{2-6}$ alkynyl"). In some embodiments, an alkynyl group has 2 to 5 carbon atoms ("$C_{2-5}$ alkynyl"). In some embodiments, an alkynyl group has 2 to 4 carbon atoms ("$C_{2-4}$ alkynyl"). In some embodiments, an alkynyl group has 2 to 3 carbon atoms ("$C_{2-3}$ alkynyl"). In some embodiments, an alkynyl group has 2 carbon atoms ("$C_2$ alkynyl"). The one or more carbon-carbon triple bonds can be internal (such as in 2-butynyl) or terminal (such as in 1-butynyl). Examples of $C_{2-4}$ alkynyl groups include, without limitation, ethynyl ($C_2$), 1-propynyl ($C_3$), 2-propynyl ($C_3$), 1-butynyl ($C_4$), 2-butynyl ($C_4$), and the like. Examples of C2-6 alkenyl groups include the aforementioned $C_{2-4}$ alkynyl groups as well as pentynyl ($C_5$), hexynyl ($C_6$), and the like. Additional examples of alkynyl include heptynyl ($C_7$), octynyl ($C_8$), and the like. Unless otherwise specified, each instance of an alkynyl group is independently optionally substituted, i.e., unsubstituted (an "unsubstituted alkynyl") or substituted (a "substituted alkynyl") with one or more substituents. In certain embodiments, the alkynyl group is unsubstituted $C_{2-10}$ alkynyl. In certain embodiments, the alkynyl group is substituted $C_{2-10}$ alkynyl.

"Carbocyclyl" or "carbocyclic" refers to a radical of a non-aromatic cyclic hydrocarbon group having from 3 to 10 ring carbon atoms ("$C_{3-10}$ carbocyclyl") and zero heteroatoms in the non-aromatic ring system. In some embodiments, a carbocyclyl group has 3 to 8 ring carbon atoms ("$C_{3-8}$ carbocyclyl"). In some embodiments, a carbocyclyl group has 3 to 6 ring carbon atoms ("$C_{3-6}$ carbocyclyl"). In some embodiments, a carbocyclyl group has 3 to 6 ring carbon atoms ("$C_{3-6}$ carbocyclyl"). In some embodiments, a carbocyclyl group has 5 to 10 ring carbon atoms ("$C_{5-10}$ carbocyclyl"). Exemplary $C_{3-6}$ carbocyclyl groups include, without limitation, cyclopropyl ($C_3$), cyclopropenyl ($C_3$), cyclobutyl ($C_4$), cyclobutenyl ($C_4$), cyclopentyl ($C_5$), cyclopentenyl ($C_5$), cyclohexyl ($C_6$), cyclohexenyl ($C_6$), cyclohexadienyl ($C_6$), and the like. Exemplary $C_{3-8}$ carbocyclyl groups include, without limitation, the aforementioned $C_{3-6}$ carbocyclyl groups as well as cycloheptyl ($C_7$), cycloheptenyl ($C_7$), cycloheptadienyl ($C_7$), cycloheptatrienyl ($C_7$), cyclooctyl ($C_8$), cyclooctenyl ($C_8$), bicyclo[2.2.1]heptanyl ($C_7$), bicyclo[2.2.2]octanyl ($C_8$), and the like. Exemplary $C_{3-10}$ carbocyclyl groups include, without limitation, the aforementioned $C_{3-8}$ carbocyclyl groups as well as cyclononyl ($C_9$), cyclononenyl ($C_9$), cyclodecyl ($C_{10}$), cyclodecenyl ($C_{10}$), octahydro-1H-indenyl ($C_9$), decahydronaphthalenyl ($C_{10}$), spiro[4.5]decanyl ($C_{10}$), and the like. As the foregoing examples illustrate, in certain embodiments, the carbocyclyl group is either monocyclic ("monocyclic carbocyclyl") or contain a fused, bridged or spiro ring system such as a bicyclic system ("bicyclic carbocyclyl") and can be saturated or can be partially unsaturated. "Carbocyclyl" also includes ring systems wherein the carbocyclic ring, as defined above, is fused with one or more aryl or heteroaryl groups wherein the point of attachment is on the carbocyclic ring, and in such instances, the number of carbons continue to designate the number of carbons in the carbocyclic ring system. Unless otherwise specified, each instance of a carbocyclyl group is independently optionally substituted, i.e., unsubstituted (an "unsubstituted carbocyclyl") or substituted (a "substituted carbocyclyl") with one or more substituents. In certain embodiments, the carbocyclyl group is unsubstituted $C_{3-10}$ carbocyclyl. In certain embodiments, the carbocyclyl group is a substituted $C_{3-19}$ carbocyclyl.

In some embodiments, "carbocyclyl" is a monocyclic, saturated carbocyclyl group having from 3 to 10 ring carbon atoms ("$C_{3-10}$ cycloalkyl"). In some embodiments, a cycloalkyl group has 3 to 8 ring carbon atoms ("$C_{3-8}$ cycloalkyl"). In some embodiments, a cycloalkyl group has 3 to 6 ring carbon atoms ("$C_{3-6}$ cycloalkyl"). In some embodiments, a cycloalkyl group has 5 to 6 ring carbon atoms ("$C_{5-6}$ cycloalkyl"). In some embodiments, a cycloalkyl group has 5 to 10 ring carbon atoms ("$C_{5-10}$ cycloalkyl"). Examples of $C_5$ cycloalkyl groups include cyclopentyl ($C_5$) and cyclohexyl ($C_5$). Examples of $C_{3-6}$ cycloalkyl groups include the aforementioned $C_{5-6}$ cycloalkyl groups as well as cyclopropyl ($C_3$) and cyclobutyl ($C_4$). Examples of $C_{3-8}$ cycloalkyl groups include the aforementioned $C_{3-6}$ cycloalkyl groups as well as cycloheptyl ($C_7$) and cyclooctyl ($C_8$). Unless otherwise specified, each instance of a cycloalkyl group is independently unsubstituted (an "unsubstituted cycloalkyl") or substituted (a "substituted cycloalkyl") with one or more substituents. In certain embodiments, the cycloalkyl group is unsubstituted $C_{3-10}$ cycloalkyl. In certain embodiments, the cycloalkyl group is substituted $C_{3-10}$ cycloalkyl.

"Aryl" refers to a radical of a monocyclic or polycyclic (e.g., bicyclic or tricyclic) 4n+2 aromatic ring system (e.g., having 6, 10, or 14 pi electrons shared in a cyclic array) having 6-14 ring carbon atoms and zero heteroatoms provided in the aromatic ring system ("$C_{6-14}$ aryl"). In some embodiments, an aryl group has six ring carbon atoms ("$C_6$ aryl"; e.g., phenyl). In some embodiments, an aryl group has ten ring carbon atoms ("$C_{10}$ aryl"; e.g., naphthyl such as 1-naphthyl and 2-naphthyl). In some embodiments, an aryl group has fourteen ring carbon atoms ("$C_{14}$ aryl"; e.g., anthracyl). "Aryl" also includes ring systems wherein the aryl ring, as defined above, is fused with one or more carbocyclyl or heterocyclyl groups wherein the radical or point of attachment is on the aryl ring, and in such instances, the number of carbon atoms continue to designate the number of carbon atoms in the aryl ring system. Unless otherwise specified, each instance of an aryl group is independently optionally substituted, i.e., unsubstituted (an "unsubstituted aryl") or substituted (a "substituted aryl") with one or more substituents. In certain embodiments, the aryl group is unsubstituted $C_{6-14}$ aryl. In certain embodiments, the aryl group is substituted $C_{6-14}$ aryl.

"Aralkyl" is a subset of alkyl and aryl and refers to an optionally substituted alkyl group substituted by an optionally substituted aryl group. In certain embodiments, the aralkyl is optionally substituted benzyl. In certain embodiments, the aralkyl is benzyl. In certain embodiments, the aralkyl is optionally substituted phenethyl. In certain embodiments, the aralkyl is phenethyl. In certain embodiments, the aralkyl is 7-phenylheptanyl. In certain embodiments, the aralkyl is C7 alkyl substituted by an optionally substituted aryl group (e.g., phenyl). In certain embodiments, the aralkyl is a C7-C10 alkyl group substituted by an optionally substituted aryl group (e.g., phenyl).

"Partially unsaturated" refers to a group that includes at least one double or triple bond. A "partially unsaturated" ring system is further intended to encompass rings having multiple sites of unsaturation but is not intended to include aromatic groups (e.g., aryl or heteroaryl groups) as defined in this application. Likewise, "saturated" refers to a group that does not contain a double or triple bond, i.e., contains all single bonds.

The term "optionally substituted" means substituted or unsubstituted.

Alkyl, alkenyl, alkynyl, carbocyclyl, heterocyclyl, aryl, and heteroaryl groups are optionally substituted (e.g., "substituted" or "unsubstituted" alkyl, "substituted" or "unsubstituted" alkenyl, "substituted" or "unsubstituted" alkynyl, "substituted" or "unsubstituted" carbocyclyl, "substituted" or "unsubstituted" heterocyclyl, "substituted" or "unsubstituted" aryl or "substituted" or "unsubstituted" heteroaryl group). In general, the term "substituted," whether preceded by the term "optionally" or not, means that at least one hydrogen present on a group (e.g., a carbon or nitrogen atom) is replaced with a permissible substituent, e.g., a substituent which upon substitution results in a stable compound, e.g., a compound which does not spontaneously undergo transformation such as by rearrangement, cyclization, elimination, or other reaction. Unless otherwise indicated, a "substituted" group has a substituent at one or more substitutable positions of the group, and when more than one position in any given structure is substituted, the substituent is either the same or different at each position. The term "substituted" is contemplated to include substitution with all permissible substituents of organic compounds, any of the substituents described in this application that results in the formation of a stable compound. The present invention contemplates any and all such combinations in order to arrive at a stable compound. For purposes of this invention, heteroatoms such as nitrogen may have hydrogen substituents and/or any suitable substituent as described in this application which satisfy the valencies of the heteroatoms and results in the formation of a stable moiety.

Exemplary carbon atom substituents include, but are not limited to, halogen, —CN, —NO$_2$, —N$_3$, —SO$_2$H, —SO$_3$H, —OH, —OR$^{aa}$, —ON(R$^{bb}$)$_2$, —N(R$^{bb}$)$_2$, —N(R$^{bb}$)$_3^+$X$^-$, —N(OR$^{aa}$)R$^{bb}$, —SH, —SR$^{aa}$, —SSR$^{aa}$, —C(=O)R$^{aa}$, —CO$_2$H, —CHO, —C(OR$^{aa}$)$_2$, —CO$_2$R$^{aa}$, —OC(=O)R$^{aa}$, —OCO$_2$R$^{aa}$, —C(=O)N(R$^{bb}$)$_2$, —OC(=O)N(R$^{bb}$)$_2$, —NR$^{bb}$C(=O)R$^{aa}$, —NR$^{bb}$CO$_2$R$^{aa}$, —NR$^{bb}$C(=O)N(R$^{bb}$)$_2$, —C(=NR$^{bb}$)R$^{aa}$, —C(=NR$^{bb}$)OR$^{aa}$, —OC(=NR$^{bb}$)R$^{aa}$, —OC(=NR$^{bb}$)OR$^{aa}$, —C(=NR$^{bb}$)N(R$^{bb}$)$_2$, —OC(=NR$^{bb}$)N(R$^{bb}$)$_2$, —NR$^{bb}$C(=NR$^{bb}$)N(R$^{bb}$)$_2$, —C(=O)NR$^{bb}$SO$_2$R$^{aa}$, —NR$^{bb}$SO$_2$R$^{aa}$, —SO$_2$N(R$^{bb}$)$_2$, —SO$_2$R$^{aa}$, —SO$_2$OR$^{aa}$, —OSO$_2$R$^{aa}$, —S(=O)R$^{aa}$, —OS(=O)R$^{aa}$, —Si(R$^{aa}$)$_3$, —OSi(R$^{aa}$)$_3$ —C(=S)N(R$^b$)$_2$, —C(=O)SR$^{aa}$, —C(=S)SR$^{aa}$, —SC(=S) SR$^{aa}$, —SC(=O)SR$^{aa}$, —OC(=O)SR$^{aa}$, —SC(=O)OR$^{aa}$, —SC(=O)R$^{aa}$, —P(=O)(R$^{aa}$)$_2$, —P(=O)(OR$^{aa}$)$_2$, —OP(=O)(R$^{aa}$)$_2$, —OP(=O)(OR$^{aa}$, —P(=O)(N(R$^{bb}$)$_2$)$_2$, —OP(=O)(N(R$^{bb}$)$_2$)$_2$, —NR$^{bb}$P(=O)(R$^1$)$_2$, —NR$^{bb}$P(=O)(OR$^{aa}$)$_2$, —NR$^{bb}$P(=O)(N(R$^{bb}$)$_2$)$_2$, —P(R$^{aa}$)$_2$, —P(OR$^{aa}$)$_2$, —P(R$^{aa}$)$_3^+$X$^-$, —P(OR$^{aa}$)$_3^+$X$^-$, —P(R$^{aa}$)$_4$, —P(OR$^{aa}$)$_4$, —OP(R$^{aa}$)$_2$, —OP(R$^{aa}$)$_3^+$X$^-$, —OP(OR$^{aa}$)$_2$, —OP(OR$^{aa}$)$_3^+$X$^-$, —OP(R$^{aa}$)$_4$, —OP(OR$^{aa}$)$_4$, —B(R$^{aa}$)$_2$, —B(OR$^{aa}$)$_2$, —BR$^{aa}$(OR$^{aa}$), $C_{1-10}$ alkyl, $C_{1-10}$ perhaloalkyl, $C_{2-10}$ alkenyl, $C_{2-10}$ alkynyl, heteroC$_{1-10}$ alkyl, heteroC$_{2-10}$ alkenyl, heteroC$_{2-10}$ alkynyl, $C_{3-10}$ carbocyclyl, 3-14 membered heterocyclyl, $C_{6-14}$ aryl, and 5-14 membered heteroaryl;

wherein:

each instance of R$^{aa}$ is, independently, selected from $C_{1-10}$ alkyl, $C_{1-10}$ perhaloalkyl, $C_{2-10}$ alkenyl, $C_{2-10}$ alkynyl, heteroC$_{1-10}$ alkyl, heteroC$_{2-10}$alkenyl, heteroC$_{2-10}$alkynyl, $C_{3-10}$ carbocyclyl, 3-14 membered heterocyclyl, $C_{6-14}$ aryl, and 5-14 membered heteroaryl, or two R$^{aa}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups;

each instance of R$^{bb}$ is, independently, selected from hydrogen, —OH, —OR$^{aa}$, —N(R$^{cc}$)$_2$, —CN, —C(=O)R$^{aa}$, —C(=O)N(R$^{cc}$)$_2$, —CO$_2$R$^{aa}$, —SO$_2$R$^{aa}$, —C(=NR$^{cc}$)OR$^{aa}$, —C(=NR$^{cc}$)N(R$^{cc}$)$_2$, —SO$_2$N(R$^{cc}$)$_2$, —SO$_2$R$^{cc}$, —SO$_2$OR$^{cc}$, —SOR$^{aa}$, —C(=S)N(R$^{cc}$)$_2$, —C(=O)SR$^{cc}$, —C(=S)SR$^{cc}$, —P(=O)(R$^{aa}$)$_2$, —P(=O)(OR$^{cc}$)$_2$, —P(=O)(N(R$^{cc}$)$_2$)$_2$, $C_{1-10}$ alkyl, $C_{1-10}$ perhaloalkyl, $C_{2-10}$ alkenyl, $C_{2-10}$ alkynyl, heteroC$_{1-10}$alkyl, heteroC$_{2-10}$alkenyl, heteroC$_{2-10}$alkynyl, $C_{3-10}$ carbocyclyl, 3-14 membered heterocyclyl, $C_{6-14}$ aryl, and 5-14 membered heteroaryl, or two R$^{bb}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups; wherein X$^-$ is a counterion;

each instance of R$^{cc}$ is, independently, selected from hydrogen, $C_{1-10}$ alkyl, $C_{1-10}$ perhaloalkyl, $C_{2-10}$ alkenyl, $C_{2-10}$ alkynyl, heteroC$_{1-10}$ alkyl, heteroC$_{2-10}$ alkenyl, heteroC$_{2-10}$ alkynyl, $C_{3-10}$ carbocyclyl, 3-14 membered heterocyclyl, $C_{6-14}$ aryl, and 5-14 membered heteroaryl, or two R$^{cc}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups;

each instance of R$^{dd}$ is, independently, selected from halogen, —CN, —NO$_2$, —N$_3$, —SO$_2$H, —SO$_3$H, —OH, —OR$^{ee}$, —ON(R$^{ff}$)$_2$, —N(R$^{ff}$)$_2$, —N(R$^{ff}$)$_3^+$X$^-$, —N(OR$^{ee}$)

$R^{ff}$, —SH, —SR$^{ee}$, —SSR$^{ee}$, —C(=O)R$^{ee}$, —CO$_2$H, —CO$_2$R$^{ee}$, —OC(=O)R$^{ee}$, —OCO$_2$R$^{ee}$, —C(=O)N(R$^{ff}$)$_2$, —OC(=O)N(R$^{ff}$)$_2$, —NR$^{ff}$C(=O)R$^{ee}$, —NR$^{ff}$CO$_2$R$^{ee}$, —NR$^{ff}$C(=O)N(R$^{ff}$)$_2$, —C(=NR$^{ff}$)OR$^{ee}$, —OC(=NR$^{ff}$)R$^{ee}$, —OC(=NR$^{ff}$)OR$^{ee}$, —C(=NR$^{ff}$)N(R$^{ff}$)$_2$, —OC(=NR$^{ff}$)N(R$^{ff}$)$_2$, —NR$^{ff}$C(=NR$^{ff}$)N(R$^{ff}$)$_2$, —NR$^{ff}$SO$_2$R$^{ee}$, —SO$_2$N(R$^{ff}$)$_2$, —SO$_2$R$^{ee}$, —SO$_2$OR$^{ee}$, —OSO$_2$R$^{ee}$, —S(=O)R$^{ee}$, —Si(R$^{ee}$)$_3$, —OSi(R$^{ee}$)$_3$, —C(=S)N(R$^{ff}$)$_2$, —C(=O)SR$^{ee}$, —C(=S)SR$^{ee}$, —SC(=S)SR$^{ee}$, —P(=O)(OR$^{ee}$)$_2$, —P(=O)(R$^{ee}$)$_2$, —OP(=O)(R$^{ee}$)$_2$, —OP(=O)(OR$^{ee}$)$_2$, C$_{1-6}$ alkyl, C$_{1-6}$ perhaloalkyl, C$_{2-6}$ alkenyl, C$_{2-6}$ alkynyl, heteroC$_{1-6}$alkyl, heteroC$_{2-6}$alkenyl, heteroC$_{2-6}$alkynyl, C$_{3-10}$ carbocyclyl, 3-10 membered heterocyclyl, C$_{6-10}$ aryl, 5-10 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups, or two geminal R$^{dd}$ substituents can be joined to form =O or =S; wherein X$^-$ is a counterion;

each instance of R$^{ee}$ is, independently, selected from C$_{1-6}$ alkyl, C$_{1-6}$ perhaloalkyl, C$_{2-6}$ alkenyl, C$_{2-6}$ alkynyl, heteroC$_{1-6}$ alkyl, heteroC$_{2-6}$alkenyl, heteroC$_{2-6}$ alkynyl, C$_{3-10}$ carbocyclyl, C$_{6-10}$ aryl, 3-10 membered heterocyclyl, and 3-10 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups;

each instance of R$^{ff}$ is, independently, selected from hydrogen, C$_{1-6}$ alkyl, C$_{1-6}$ perhaloalkyl, C$_{2-6}$ alkenyl, C$_{2-6}$ alkynyl, heteroC$_{1-6}$alkyl, heteroC$_{2-6}$alkenyl, heteroC$_{2-6}$alkynyl, C$_{3-10}$ carbocyclyl, 3-10 membered heterocyclyl, C$_{6-10}$ aryl and 5-10 membered heteroaryl, or two R$^{ff}$ groups are joined to form a 3-10 membered heterocyclyl or 5-10 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups; and each instance of R$^{gg}$ is, independently, halogen, —CN, —NO$_2$, —N$_3$, —SO$_2$H, —SO$_3$H, —OH, —OC$_{1-6}$ alkyl, —ON(C$_{1-6}$ alkyl)$_2$, —N(C$_{1-6}$ alkyl)$_2$, —N(C$_{1-6}$ alkyl)$_3$$^+$X$^-$, —NH(C$_{1-6}$ alkyl)$_2$$^+$X$^-$, —NH$_2$(C$_{1-6}$ alkyl)$^+$X$^-$, —NH$_3$$^+$X$^-$, —N(OC$_{1-6}$ alkyl)(C$_{1-6}$ alkyl), —N(OH)(C$_{1-6}$ alkyl), —NH(OH), —SH, —SC$_{1-6}$ alkyl, —SS(C$_{1-6}$ alkyl), —C(=O)(C$_{1-6}$ alkyl), —CO$_2$H, —CO$_2$(C$_{1-6}$ alkyl), —OC(=O)(C$_{1-6}$ alkyl), —OCO$_2$(C$_{1-6}$ alkyl), —C(=O)NH$_2$, —C(=O)N(C$_{1-6}$ alkyl)$_2$, —OC(=O)NH(C$_{1-6}$ alkyl), —NHC(=O)(C$_{1-6}$ alkyl), —N(C$_{1-6}$ alkyl)C(=O)(C$_{1-6}$ alkyl), —NHCO$_2$(C$_{1-6}$ alkyl), —NHC(=O)N(C$_{1-6}$ alkyl)$_2$, —NHC(=O)NH(C$_{1-6}$ alkyl), —NHC(=O)NH$_2$, —C(=NH)O(C$_{1-6}$ alkyl), —OC(=NH)(C$_{1-6}$ alkyl), —OC(=NH)OC$_{1-6}$ alkyl, —C(=NH)N(C$_{1-6}$ alkyl)$_2$, —C(=NH)NH(C$_{1-6}$ alkyl), —C(=NH)NH$_2$, —OC(=NH)N(C$_{1-6}$ alkyl)$_2$, —OC(NH)NH(C$_{1-6}$ alkyl), —OC(NH)NH$_2$, —NHC(NH)N(C$_{1-6}$ alkyl)$_2$, —NHC(=NH)NH$_2$, —NHSO$_2$(C$_{1-6}$ alkyl), —SO$_2$N(C$_{1-6}$ alkyl)$_2$, —SO$_2$NH(C$_{1-6}$ alkyl), —SO$_2$NH$_2$, —SO$_2$C$_{1-6}$ alkyl, —SO$_2$OC$_{1-6}$ alkyl, —OSO$_2$C$_{1-6}$ alkyl, —SOC$_{1-6}$ alkyl, —Si(C$_{1-6}$ alkyl)$_3$, —OSi(C$_{1-6}$ alkyl)$_3$-C(=S)N(C$_{1-6}$ alkyl)$_2$, C(=S)NH(C$_{1-6}$ alkyl), C(=S)NH$_2$, —C(=O)S(C$_{1-6}$ alkyl), —C(=S)SC$_{1-6}$ alkyl, —SC(=S)SC$_{1-6}$ alkyl, —P(=O)(OC$_{1-6}$ alkyl)$_2$, —P(=O)(C$_{1-6}$ alkyl)$_2$, —OP(=O)(C$_{1-6}$ alkyl)$_2$, —OP(=O)(OC$_{1-6}$ alkyl)$_2$, C$_{1-6}$ alkyl, C$_{1-6}$ perhaloalkyl, C$_{2-6}$ alkenyl, C$_{2-6}$ alkynyl, heteroC$_{1-6}$alkyl, heteroC$_{2-6}$alkenyl, heteroC$_{2-6}$alkynyl, C$_{3-10}$ carbocyclyl, C$_{6-10}$ aryl, 3-10 membered heterocyclyl, 5-10 membered heteroaryl; or two geminal R$^{gg}$ substituents can be joined to form =O or =S; wherein X$^-$ is a counterion. Alternatively, two geminal hydrogens on a carbon atom are replaced with the group =O, =S, =NN(R$^{bb}$)$_2$, =NNR$^{bb}$C(=O)R$^{aa}$, =NNR$^{bb}$C(=O)OR$^{aa}$, =NNR$^{bb}$S(=O)$_2$R$^{aa}$, =NR$^{bb}$, or =NOR$^{cc}$; wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups; wherein X$^-$ is a counterion;

wherein:

each instance of R$^{aa}$ is, independently, selected from C$_{1-10}$ alkyl, C$_{1-10}$ perhaloalkyl, C$_{2-10}$ alkenyl, C$_{2-10}$ alkynyl, heteroC$_{1-10}$ alkyl, heteroC$_{2-10}$alkenyl, heteroC$_{2-10}$alkynyl, C$_{3-10}$ carbocyclyl, 3-14 membered heterocyclyl, C$_{6-14}$ aryl, and 5-14 membered heteroaryl, or two R$^{aa}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups;

each instance of R$^{bb}$ is, independently, selected from hydrogen, —OH, —OR$^{aa}$, —N(R$^{cc}$)$_2$, —CN, —C(=O)R$^{aa}$, —C(=O)N(R$^{cc}$)$_2$, —CO$_2$R$^{aa}$, —SO$_2$R$^{aa}$, —C(=NR$^{cc}$)OR$^{aa}$, —C(=NR$^{cc}$)N(R$^{cc}$)$_2$, —SO$_2$N(R$^{cc}$)$_2$, —SO$_2$R$^{cc}$, —SO$_2$OR$^{cc}$, —SOR$^{aa}$, —C(=S)N(R$^{cc}$)$_2$, —C(=O)SR$^{cc}$, —C(=S)SR$^{cc}$, —P(=O)(R$^{aa}$)$_2$, —P(=O)(OR$^{cc}$)$_2$, —P(=O)(N(R$^{cc}$)$_2$)$_2$, C$_{1-10}$ alkyl, C$_{1-10}$ perhaloalkyl, C$_{2-10}$ alkenyl, C$_{2-10}$ alkynyl, heteroC$_{1-10}$alkyl, heteroC$_{2-10}$alkenyl, heteroC$_{2-10}$alkynyl, C$_{3-10}$ carbocyclyl, 3-14 membered heterocyclyl, C$_{6-14}$ aryl, and 5-14 membered heteroaryl, or two R$^{bb}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups; wherein X$^-$ is a counterion;

each instance of R$^{cc}$ is, independently, selected from hydrogen, C$_{1-10}$ alkyl, C$_{1-10}$ perhaloalkyl, C$_{2-10}$ alkenyl, C$_{2-10}$ alkynyl, heteroC$_{1-10}$ alkyl, heteroC$_{2-10}$ alkenyl, heteroC$_{2-10}$ alkynyl, C$_{3-10}$ carbocyclyl, 3-14 membered heterocyclyl, C$_{6-14}$ aryl, and 5-14 membered heteroaryl, or two R$^{cc}$ groups are joined to form a 3-14 membered heterocyclyl or 5-14 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{dd}$ groups;

each instance of R$^{dd}$ is, independently, selected from halogen, —CN, —NO$_2$, —N$_3$, —SO$_2$H, —SO$_3$H, —OH, —OR$^{ee}$, —ON(R$^{ff}$)$_2$, —N(R$^{ff}$)$_2$, —N(R$^{ff}$)$_3$$^+$X$^-$, —N(OR$^{ee}$)R$^{ff}$, —SH, —SR$^{ee}$, —SSR$^{ee}$, —C(=O)R$^{ee}$, —CO$_2$H, —CO$_2$R$^{ee}$, —OC(=O)R$^{ee}$, —OCO$_2$R$^{ee}$, —C(=O)N(R$^{ff}$)$_2$, —OC(=O)N(R$^{ff}$)$_2$, —NR$^{ff}$C(=O)R$^{ee}$, —NR$^{ff}$CO$_2$R$^{ee}$, —NR$^{ff}$C(=O)N(R$^{ff}$)$_2$, —C(=NR$^{ff}$)OR$^{ee}$, —OC(=NR$^{ff}$)R$^{ee}$, —OC(=NR$^{ff}$)OR$^{ee}$, —C(=NR$^{ff}$)N(R$^{ff}$)$_2$, —OC(=NR$^{ff}$)N(R$^{ff}$)$_2$, —NR$^{ff}$C(=NR$^{ff}$)N(R$^{ff}$)$_2$, —NR$^{ff}$SO$_2$R$^{ee}$, —SO$_2$N(R$^{ff}$)$_2$, —SO$_2$R$^{ee}$, —SO$_2$OR$^{ee}$, —OSO$_2$R$^{ee}$, —S(=O)R$^{ee}$, —Si(R$^{ee}$)$_3$, —OSi(R$^{ee}$)$_3$, —C(=S)N(R$^{ff}$)$_2$, —C(=O)SR$^{ee}$, —C(=S)SR$^{ee}$, —SC(=S)SR$^{ee}$, —P(=O)(OR$^{ee}$)$_2$, —P(=O)(R$^{ee}$)$_2$, —OP(=O)(R$^{ee}$)$_2$, —OP(=O)(OR$^{ee}$)$_2$, C$_{1-6}$ alkyl, C$_{1-6}$ perhaloalkyl, C$_{2-6}$ alkenyl, C$_{2-6}$ alkynyl, heteroC$_{1-6}$alkyl, heteroC$_{2-6}$alkenyl, heteroC$_{2-6}$alkynyl, C$_{3-10}$ carbocyclyl, 3-10 membered heterocyclyl, C$_{6-10}$ aryl, 5-10 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups, or two geminal R$^{dd}$ substituents can be joined to form =O or =S; wherein X$^-$ is a counterion;

each instance of R$^{ee}$ is, independently, selected from C$_{1-6}$ alkyl, C$_{1-6}$ perhaloalkyl, C$_{2-6}$ alkenyl, C$_{2-6}$ alkynyl, heteroC$_{1-6}$ alkyl, heteroC$_{2-6}$alkenyl, heteroC$_{2-6}$ alkynyl, C$_{3-10}$ carbocyclyl, C$_{6-10}$ aryl, 3-10 membered heterocyclyl, and 3-10 membered heteroaryl, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups;

each instance of R$^{ff}$ is, independently, selected from hydrogen, C$_{1-6}$ alkyl, C$_{1-6}$ perhaloalkyl, C$_{2-6}$ alkenyl, C$_{2-6}$ alkynyl, heteroC$_{1-6}$alkyl, heteroC$_{2-6}$alkenyl, heteroC$_{2-6}$alkynyl, C$_{3-10}$ carbocyclyl, 3-10 membered heterocyclyl, C$_{6-10}$ aryl and 5-10 membered heteroaryl, or two R$^{ff}$ groups are joined to form a 3-10 membered heterocyclyl or 5-10 membered heteroaryl ring, wherein each alkyl, alkenyl, alkynyl, heteroalkyl, heteroalkenyl, heteroalkynyl, carbocyclyl, heterocyclyl, aryl, and heteroaryl is independently substituted with 0, 1, 2, 3, 4, or 5 R$^{gg}$ groups; and each instance of R$^{gg}$ is, independently, halogen, —CN, —NO$_2$, —N$_3$, —SO$_2$H, —SO$_3$H, —OH, —OC$_{1-6}$ alkyl, —ON(C$_{1-6}$ alkyl)$_2$, —N(C$_{1-6}$ alkyl)$_2$, —N(C$_{1-6}$ alkyl)$_3$$^+$X$^-$, —NH(C$_{1-6}$ alkyl)$_2$$^+$X$^-$, —NH$_2$(C$_{1-6}$ alkyl)$^+$X$^-$, —NH$_3$$^+$X$^-$, —N(OC$_{1-6}$ alkyl)(C$_{1-6}$ alkyl), —N(OH)(C$_{1-6}$ alkyl), —NH(OH), —SH, —SC$_{1-6}$ alkyl, —SS(C$_{1-6}$ alkyl), —C(=O)(C$_{1-6}$ alkyl), —CO$_2$H, —CO$_2$(C$_{1-6}$ alkyl), —OC(=O)(C$_{1-6}$ alkyl), —OCO$_2$(C$_{1-6}$ alkyl), —C(=O)NH$_2$, —C(=O)N(C$_{1-6}$ alkyl)$_2$, —OC(=O)NH(C$_{1-6}$ alkyl), —NHC(=O)(C$_{1-6}$ alkyl), —N(C$_{1-6}$ alkyl)C(=O)(C$_{1-6}$ alkyl), —NHCO$_2$(C$_{1-6}$ alkyl), —NHC(=O)N(C$_{1-6}$ alkyl)$_2$, —NHC(=O)NH(C$_{1-6}$ alkyl), —NHC(=O)NH$_2$, —C(=NH)O(C$_{1-6}$ alkyl), —OC(=NH)(C$_{1-6}$ alkyl), —OC(=NH)OC$_{1-6}$ alkyl, —C(=NH)N(C$_{1-6}$ alkyl)$_2$, —C(=NH)NH(C$_{1-6}$ alkyl), —C(=NH)NH$_2$, —OC(=NH)N(C$_{1-6}$ alkyl)$_2$, —OC(NH)NH(C$_{1-6}$ alkyl), —OC(NH)NH$_2$, —NHC(NH)N(C$_{1-6}$ alkyl)$_2$, —NHC(=NH)NH$_2$, —NHSO$_2$(C$_{1-6}$ alkyl), —SO$_2$N(C$_{1-6}$ alkyl)$_2$, —SO$_2$NH(C$_{1-6}$ alkyl), —SO$_2$NH$_2$, —SO$_2$C$_{1-6}$ alkyl, —SO$_2$OC$_{1-6}$ alkyl, —OSO$_2$C$_{1-6}$ alkyl, —SOC$_{1-6}$ alkyl, —Si(C$_{1-6}$ alkyl)$_3$, —OSi(C$_{1-6}$ alkyl)$_3$-C(=S)N(C$_{1-6}$ alkyl)$_2$, C(=S)NH(C$_{1-6}$ alkyl), C(=S)NH$_2$, —C(=O)S(C$_{1-6}$ alkyl), —C(=S)SC$_{1-6}$ alkyl, —SC(=S)SC$_{1-6}$ alkyl, —P(=O)(OC$_{1-6}$ alkyl)$_2$, —P(=O)(C$_{1-6}$ alkyl)$_2$, —OP(=O)(C$_{1-6}$ alkyl)$_2$, —OP(=O)(OC$_{1-6}$ alkyl)$_2$, C$_{1-6}$ alkyl, C$_{1-6}$ perhaloalkyl, C$_{2-6}$ alkenyl, C$_{2-6}$ alkynyl, heteroC$_{1-6}$alkyl, heteroC$_{2-6}$alkenyl, heteroC$_{2-6}$alkynyl, C$_{3-10}$ carbocyclyl, C$_{6-10}$ aryl, 3-10 membered heterocyclyl, 5-10 membered heteroaryl; or two geminal R$^{gg}$ substituents can be joined to form =O or =S; wherein X$^-$ is a counterion.

A "counterion" or "anionic counterion" is a negatively charged group associated with a positively charged group in order to maintain electronic neutrality. An anionic counterion may be monovalent (i.e., including one formal negative charge). An anionic counterion may also be multivalent (i.e., including more than one formal negative charge), such as divalent or trivalent. Exemplary counterions include halide ions (e.g, F$^-$, Cl$^-$, Br$^-$, I$^-$), NO$_3$$^-$, ClO$_4$$^-$, OH$^-$, H$_2$PO$_4$$^-$, HCO$_3$$^-$, HSO$_4$$^-$, sulfonate ions (e.g, methansulfonate, trifluoromethanesulfonate, p-toluenesulfonate, benzenesulfonate, 10-camphor sulfonate, naphthalene-2-sulfonate, naphthalene-1-sulfonic acid-5-sulfonate, ethan-1-sulfonic acid-2-sulfonate, and the like), carboxylate ions (e.g, acetate, propanoate, benzoate, glycerate, lactate, tartrate, glycolate, gluconate, and the like), BF$_4$$^-$, PF$_4$$^-$, PF$_6$$^-$, AsF$_6$$^-$, SbF$_6$$^-$, B[3,5-(CF$_3$)$_2$C$_6$H$_3$]$_4$$^-$, B(C$_6$F$_5$)$_4$$^-$, BPh$_4$$^-$, Al(OC(CF$_3$)$_3$)$_4$$^-$, and carborane anions (e.g, CB$_{11}$H$_{12}$$^-$ or (HCB$_{11}$Me$_5$Br$_6$)$^-$). Exemplary counterions which may be multivalent include CO$_3$$^{2-}$, HPO$_4$$^{2-}$, PO$_4$$^{3-}$, B$_4$O$_7$$^{2-}$, SO$_4$$^{2-}$, S$_2$O$_3$$^{2-}$, carboxylate anions (e.g., tartrate, citrate, fumarate, maleate, malate, malonate, gluconate, succinate, glutarate, adipate, pimelate, suberate, azelate, sebacate, salicylate, phthalates, aspartate, glutamate, and the like), and carboranes.

The term "pharmaceutically acceptable salt" refers to those salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, Berge et al, describe pharmaceutically acceptable salts in detail in *J. Pharmaceutical Sciences*, 1977, 66, 1-19, incorporated by reference. Pharmaceutically acceptable salts of the compounds disclosed in this application include those derived from suitable inorganic and organic acids and bases. Examples of pharmaceutically acceptable, nontoxic acid addition salts are salts of an amino group formed with inorganic acids such as hydrochloric acid, hydrobromic acid, phosphoric acid, sulfuric acid, and perchloric acid or with organic acids such as acetic acid, oxalic acid, maleic acid, tartaric acid, citric acid, succinic acid, or malonic acid or by using other methods known in the art such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecyl sulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Salts derived from appropriate bases include alkali metal, alkaline earth metal, ammonium and N$^+$(C$_{1-4}$ alkyl)$_4$$^-$ salts. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate, and aryl sulfonate.

The term "solvate" refers to forms of a compound that are associated with a solvent, usually by a solvolysis reaction. This physical association may include hydrogen bonding. Conventional solvents include water, methanol, ethanol, acetic acid, DMSO, THF, diethyl ether, and the like. The compounds of Formula (1), (9), (10), and (11) may be prepared, e.g., in crystalline form, and may be solvated. Suitable solvates include pharmaceutically acceptable solvates and further include both stoichiometric solvates and non-stoichiometric solvates. In certain instances, the solvate will be capable of isolation, for example, when one or more solvent molecules are incorporated in the crystal lattice of a crystalline solid. "Solvate" encompasses both solution-phase and isolable solvates. Representative solvates include hydrates, ethanolates, and methanolates.

The term "hydrate" refers to a compound that is associated with water. Typically, the number of the water molecules contained in a hydrate of a compound is in a definite ratio to the number of the compound molecules in the hydrate. Therefore, a hydrate of a compound may be represented, for example, by the general formula Rx H$_2$O, wherein R is the compound and wherein x is a number greater than 0. A given compound may form more than one type of hydrates, including, e.g., monohydrates (x is 1), lower hydrates (x is a number greater than 0 and smaller than 1, e.g., hemihydrates (R.0.5 H$_2$O)), and polyhydrates (x is a number greater than 1, e.g., dihydrates (R.2 H$_2$O) and hexahydrates (R.6 H$_2$O)).

The term "tautomers" refer to compounds that are interchangeable forms of a particular compound structure, and that vary in the displacement of hydrogen atoms and electrons. Thus, two structures may be in equilibrium through the movement of n electrons and an atom (usually H). For example, enols and ketones are tautomers because they are rapidly interconverted by treatment with either acid or base. Another example of tautomerism is the aci- and nitro-forms of phenylnitromethane, which are likewise formed by treatment with acid or base. Tautomeric forms may be relevant to the attainment of the optimal chemical reactivity and biological activity of a compound of interest.

It is also to be understood that compounds that have the same molecular formula but differ in the nature or sequence of bonding of their atoms or the arrangement of their atoms in space are termed "isomers." Isomers that differ in the arrangement of their atoms in space are termed "stereoisomers."

Stereoisomers that are not mirror images of one another are termed "diastereomers" and those that are non-superimposable mirror images of each other are termed "enantiomers." When a compound has an asymmetric center, for example, it is bonded to four different groups, a pair of enantiomers is possible. An enantiomer can be characterized by the absolute configuration of its asymmetric center and described by the R- and S-sequencing rules of Cahn and Prelog. An enantiomer can also be characterized by the manner in which the molecule rotates the plane of polarized light, and designated as dextrorotatory or levorotatory (i.e., as (+) or (−)-isomers respectively). A chiral compound can exist as either an individual enantiomer or as a mixture of enantiomers. A mixture containing equal proportions of the enantiomers is called a "racemic mixture."

The term "co-crystal" refers to a crystalline structure comprising at least two different components (e.g., a compound described in this application and an acid), wherein each of the components is independently an atom, ion, or molecule. In certain embodiments, none of the components is a solvent. In certain embodiments, at least one of the components is a solvent. A co-crystal of a compound and an acid is different from a salt formed from a compound and the acid. In the salt, a compound described in this application is complexed with the acid in a way that proton transfer (e.g., a complete proton transfer) from the acid to a compound described in this application easily occurs at room temperature. In the co-crystal, however, a compound described in this application is complexed with the acid in a way that proton transfer from the acid to a compound described in this application does not easily occur at room temperature. In certain embodiments, in the co-crystal, there is no proton transfer from the acid to a compound described in this application. In certain embodiments, in the co-crystal, there is partial proton transfer from the acid to a compound described in this application. Co-crystals may be useful to improve the properties (e.g., solubility, stability, and ease of formulation) of a compound described in this application.

The term "polymorphs" refers to a crystalline form of a compound (or a salt, hydrate, or solvate thereof) in a particular crystal packing arrangement. All polymorphs of the same compound have the same elemental composition. Different crystalline forms usually have different X-ray diffraction patterns, infrared spectra, melting points, density, hardness, crystal shape, optical and electrical properties, stability, and solubility. Recrystallization solvent, rate of crystallization, storage temperature, and other factors may cause one crystal form to dominate. Various polymorphs of a compound can be prepared by crystallization under different conditions.

The term "prodrug" refers to compounds, including derivatives of the compounds of Formula (X), (8), (9), (10), or (11), that have cleavable groups and become by solvolysis or under physiological conditions the compounds of Formula (X), (8), (9), (10), or (11) and that are pharmaceutically active in vivo. The prodrugs may have attributes such as, without limitation, solubility, bioavailability, tissue compatibility, or delayed release in a mammalian organism. Examples include, but are not limited to, derivatives of compounds described in this application, including derivatives formed from glycosylation of the compounds described in this application (e.g., glycoside derivatives), carrier-linked prodrugs (e.g, ester derivatives), bioprecursor prodrugs (a prodrug metabolized by molecular modification into the active compound), and the like. Non-limiting examples of glycoside derivatives are disclosed in and incorporated by reference from WO2018208875 and US20190078168. Non-limiting examples of ester derivatives are disclosed in and incorporated by reference from US20170362195.

Other derivatives of the compounds of this invention have activity in both their acid and acid derivative forms, but the acid sensitive form often offers advantages of solubility, bioavailability, tissue compatibility, or delayed release in a mammalian organism (see, Bundgard, H., *Design of Prodrugs*, pp. 7-9, 21-24, Elsevier, Amsterdam 1985). Prodrugs include acid derivatives well known to practitioners of the art, such as, for example, esters prepared by reaction of the parent acid with a suitable alcohol, or amides prepared by reaction of the parent acid compound with a substituted or unsubstituted amine, or acid anhydrides, or mixed anhydrides. Simple aliphatic or aromatic esters, amides, and anhydrides derived from acidic groups pendant on the compounds of this invention are particular prodrugs. In some cases it is desirable to prepare double ester type prodrugs such as (acyloxy)alkyl esters or ((alkoxycarbonyl)oxy)alkylesters. $C_1$-$C_8$ alkyl, $C_2$-$C_8$ alkenyl, $C_2$-$C_8$ alkynyl, aryl, $C_7$-$C_{12}$ substituted aryl, and $C_7$-$C_{12}$ arylalkyl esters of the compounds of Formula (X), (8), (9), (10), or (11) may be preferred.

Cannabinoids

As used in this application, the term "cannabinoid" includes compounds of Formula (X):

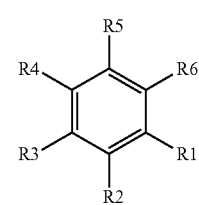

Formula (X)

or a pharmaceutically acceptable salt, co-crystal, tautomer, stereoisomer, solvate, hydrate, polymorph, isotopically enriched derivative, or prodrug thereof, wherein R1 is hydrogen, optionally substituted acyl, optionally substituted alkyl, optionally substituted alkenyl, optionally substituted alkynyl, optionally substituted carbocyclyl, or optionally substituted aryl; R2 and R6 are, independently, hydrogen or carboxyl; R3 and R5 are, independently, hydroxyl, halogen, or alkoxy; and R4 is a hydrogen or an optionally substituted prenyl moiety; or optionally R4 and R3 are taken together with their intervening atoms to form a cyclic moiety, or optionally R4 and R5 are taken together with their intervening atoms to form a cyclic moiety, or optionally both 1) R4 and R3 are taken together with their intervening atoms to form a cyclic moiety and 2) R4 and R5 are taken together with their intervening atoms to form a cyclic moiety. In certain embodiments, R4 and R3 are taken together with their intervening atoms to form a cyclic moiety. In certain embodiments, R4 and R5 are taken together with their intervening atoms to form a cyclic moiety. In certain embodiments, "cannabinoid" refers to a compound of Formula (X), or a pharmaceutically acceptable salt thereof. In certain embodiments, both 1) R4 and R3 are taken together with their intervening atoms to form a cyclic moiety and 2) R4 and R5 are taken together with their intervening atoms to form a cyclic moiety.

In some embodiments, cannabinoids may be synthesized via the following steps: a) one or more reactions to incorporate three additional ketone moieties onto an acyl-CoA scaffold, where the acyl moiety in the acyl-CoA scaffold comprises between four and fourteen carbons; b) a reaction cyclizing the product of step (a); and c) a reaction to incorporate a prenyl moiety to the product of step (b) or a derivative of the product of step (b). In some embodiments, non-limiting examples of the acyl-CoA scaffold described in step (a) include hexanoyl-CoA and butyryl-CoA. In some embodiments, non-limiting examples of the product of step (b) or a derivative of the product of step (b) include olivetolic acid and divarinic acid.

In some embodiments, a cannabinoid compound of Formula (X) is of Formula (X-A), (X-B), or (X-C):

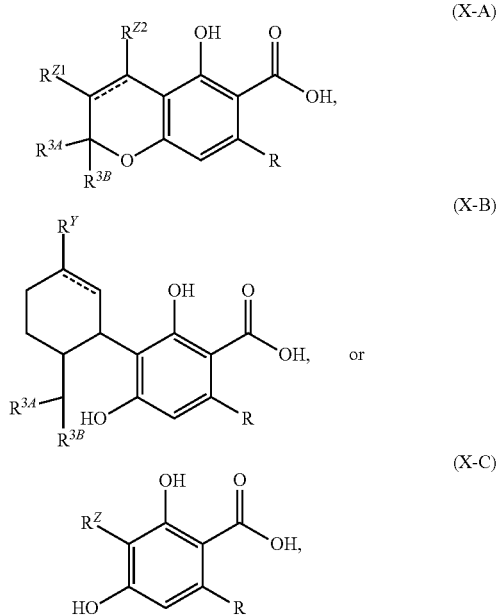

or a pharmaceutically acceptable salt, solvate, hydrate, polymorph, co-crystal, tautomer, stereoisomer, isotopically labeled derivative, or prodrug thereof; wherein $=$ is a double bond or a single bond, as valency permits;

R is hydrogen, optionally substituted acyl, optionally substituted alkyl, optionally substituted alkenyl, optionally substituted alkynyl, optionally substituted carbocyclyl, or optionally substituted aryl;

$R^{Z1}$ is hydrogen, optionally substituted acyl, optionally substituted alkyl, optionally substituted alkenyl, optionally substituted alkynyl, optionally substituted carbocyclyl, or optionally substituted aryl;

$R^{Z2}$ is hydrogen, optionally substituted acyl, optionally substituted alkyl, optionally substituted alkenyl, optionally substituted alkynyl, optionally substituted carbocyclyl, or optionally substituted aryl;

or optionally, $R^{Z1}$ and $R^{Z2}$ are taken together with their intervening atoms to form an optionally substituted carbocyclic ring;

$R^{3A}$ is hydrogen, optionally substituted acyl, optionally substituted alkyl, optionally substituted alkenyl, or optionally substituted alkynyl;

$R^{3B}$ is hydrogen, optionally substituted acyl, optionally substituted alkyl, optionally substituted alkenyl, or optionally substituted alkynyl;

$R^{Y}$ is hydrogen, optionally substituted acyl, optionally substituted alkyl, optionally substituted alkenyl, or optionally substituted alkynyl;

$R^{Z}$ is hydrogen, optionally substituted acyl, optionally substituted alkyl, optionally substituted alkenyl, or optionally substituted alkynyl.

In certain embodiments, a cannabinoid compound is of Formula (X-A):


wherein $=$ is a double bond, and each of $R^{Z1}$ and $R^{Z2}$ is hydrogen, one of $R^{3A}$ and $R^{3B}$ is optionally substituted $C_{2-6}$ alkenyl, and the other one of $R^{3A}$ and $R^{3B}$ is optionally substituted $C_{2-6}$ alkyl. In some embodiments, a cannabinoid compound of Formula (X) is of Formula (X-A), wherein each of $R^{Z1}$ and $R^{Z2}$ is hydrogen, one of $R^{3A}$ and $R^{3B}$ is a prenyl group, and the other one of $R^{3A}$ and $R^{3B}$ is optionally substituted methyl.

In certain embodiments, a cannabinoid compound of Formula (X) of Formula (X-A) is of Formula (11-z):

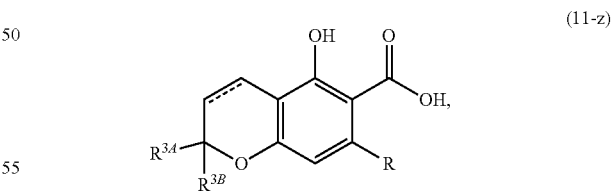

wherein $=$ is a double bond or single bond, as valency permits; one of $R^{3A}$ and $R^{3B}$ is $C_{1-6}$ alkyl optionally substituted with alkenyl, and the other of $R^{3A}$ and $R^{3B}$ is optionally substituted $C_{1-6}$ alkyl. In certain embodiments, in a compound of Formula (11-z), $=$ is a single bond; one of $R^{3A}$ and $R^{3B}$ is $C_{1-6}$ alkyl optionally substituted with prenyl; and the other of one of $R^{3A}$ and $R^{3B}$ is unsubstituted methyl; and R is as described in this application. In certain embodiments, in a compound of Formula (11-z), $=$ is a single bond; one of $R^{3A}$ and $R^{3B}$ is

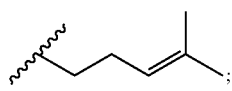 [SMILES: *CCC=C(C)C]

and the other of one of $R^{3A}$ and $R^{3B}$ is unsubstituted methyl; and R is as described in this application. In certain embodiments, a cannabinoid compound of Formula (11-z) is of Formula (11a):

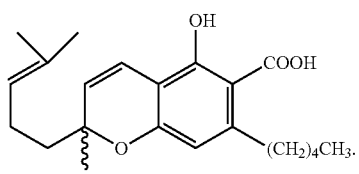

(11a)

In certain embodiments, a cannabinoid compound of Formula (X) of Formula (X-A) is of Formula (11a):

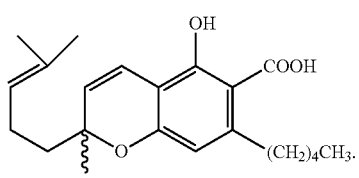

(11a)

In certain embodiments, a cannabinoid compound of Formula (X-A) is of Formula

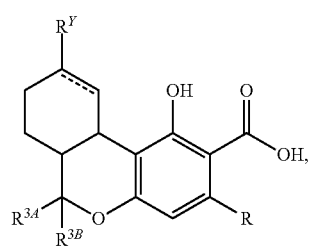

(10-z)

wherein $=$ is a double bond or single bond, as valency permits; $R^Y$ is hydrogen, optionally substituted acyl, optionally substituted alkyl, optionally substituted alkenyl, or optionally substituted alkynyl; and each of $R^{3A}$ and $R^{3B}$ is independently optionally substituted $C_{1-6}$ alkyl. In certain embodiments, in a compound of Formula (10-z), $=$ is a single bond; each of $R^{3A}$ and $R^{3B}$ is unsubstituted methyl, and R is as described in this application. In certain embodiments, a cannabinoid compound of Formula (10-z) is of Formula (10a):

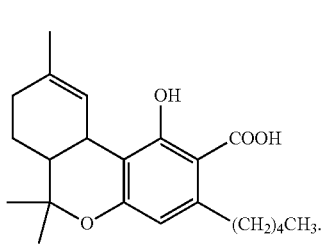

(10a)

In certain embodiments, a compound of Formula (10a)

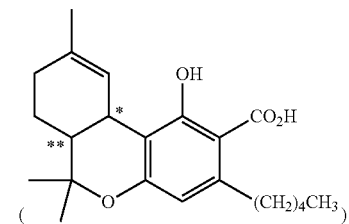

has a chiral atom labeled with * at carbon 10 and a chiral atom labeled with ** at carbon 6. In certain embodiments, in a compound of Formula (10a)

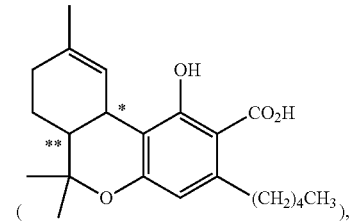

the chiral atom labeled with * at carbon 10 is of the R-configuration or R-configuration; and a chiral atom labeled with ** at carbon 6 is of the R-configuration. In certain embodiments, in a compound of Formula (10a)

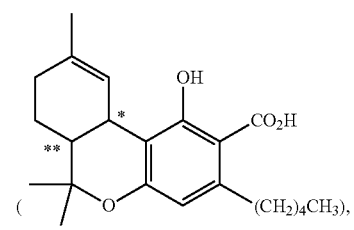

the chiral atom labeled with * at carbon 10 is of the R-configuration; and a chiral atom labeled with ** at carbon 6 is of the R-configuration or R-configuration. In certain embodiments, in a compound of Formula (10a)

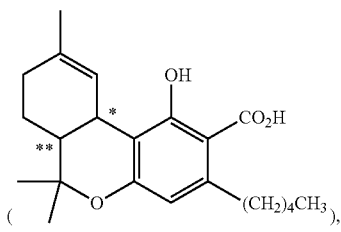

the chiral atom labeled with * at carbon 10 is of the R-configuration and a chiral atom labeled with ** at carbon 6 is of the R-configuration. In certain embodiments, a compound of Formula (10a)

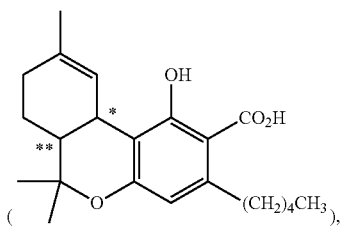

is of the formula:

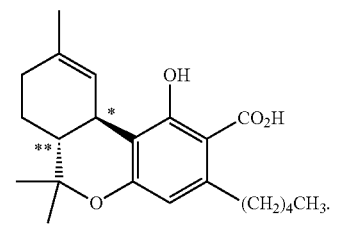

In certain embodiments, in a compound of Formula (10a)

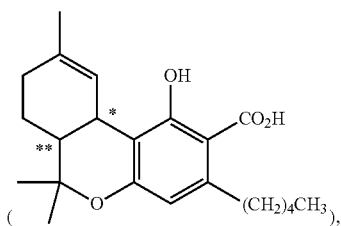

the chiral atom labeled with * at carbon 10 is of the R-configuration and a chiral atom labeled with ** at carbon 6 is of the R-configuration. In certain embodiments, a compound of Formula (10a)

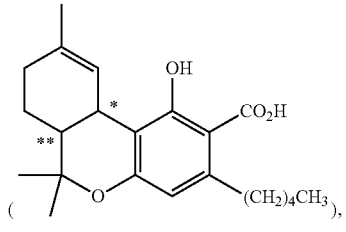

is of the formula:

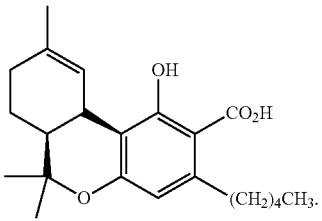

In certain embodiments, a cannabinoid compound is of Formula (X-B):

(X-B)

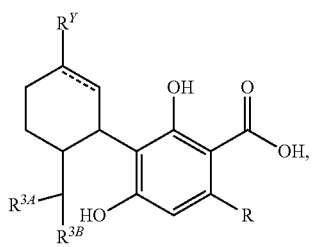

wherein $=\!=$ is a double bond; $R^Y$ is hydrogen, optionally substituted acyl, optionally substituted alkyl, optionally substituted alkenyl, or optionally substituted alkynyl; and each of $R^{3A}$ and $R^{3B}$ is independently optionally substituted $C_{1-6}$ alkyl. In certain embodiments, in a compound of Formula (X-B), $R^Y$ is optionally substituted $C_{1-6}$ alkyl; one of $R^{3A}$ and $R^{3B}$ is

and the other one of $R^{3A}$ and $R^{3B}$ is unsubstituted methyl, and R is as described in this application. In certain embodiments, a compound of Formula (X-B) is of Formula 9(a):

(9a)

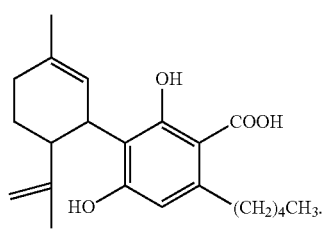

In certain embodiments, a compound of Formula (9a)

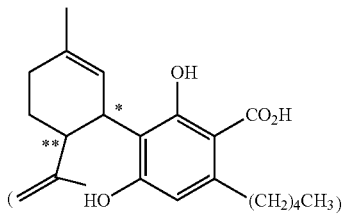

has a chiral atom labeled with * at carbon 3 and a chiral atom labeled with ** at carbon 4. In certain embodiments, in a compound of Formula (9a)

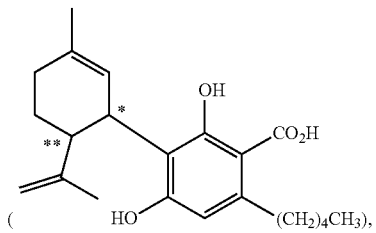

the chiral atom labeled with * at carbon 3 is of the R-configuration or S-configuration; and a chiral atom labeled with ** at carbon 4 is of the R-configuration. In certain embodiments, in a compound of Formula (9a)

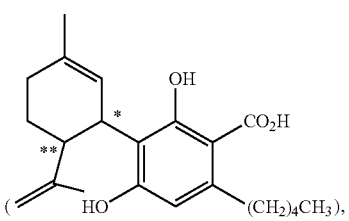

the chiral atom labeled with * at carbon 3 is of the S-configuration; and a chiral atom labeled with ** at carbon 4 is of the S-configuration or S-configuration. In certain embodiments, in a compound of Formula (9a)

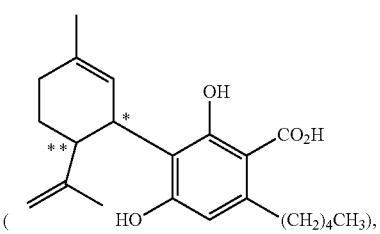

the chiral atom labeled with * at carbon 3 is of the R-configuration and a chiral atom labeled with ** at carbon 4 is of the R-configuration. In certain embodiments, a compound of Formula (9a)

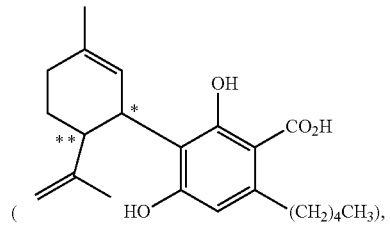

is of the formula:

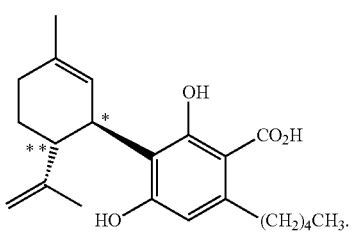

In certain embodiments, in a compound of Formula (9a)

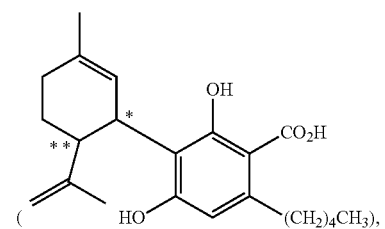

the chiral atom labeled with * at carbon 3 is of the S-configuration and a chiral atom labeled with ** at carbon 4 is of the S-configuration. In certain embodiments, a compound of Formula (9a)

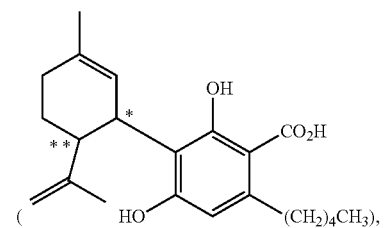

is of the formula:

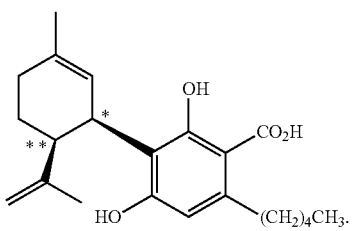

In certain embodiments, a cannabinoid compound is of Formula (X-C):

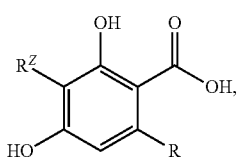

(X-C)

wherein $R^Z$ is optionally substituted alkyl or optionally substituted alkenyl. In certain embodiments, a compound of Formula (X-C) is of formula:

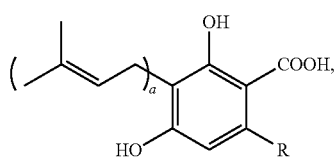

(8')

wherein a is 1, 2, 3, 4, 5, 6, 7, 8, 9, or 10. In certain embodiments, a is 1. In certain embodiments, a is 2. In certain embodiments, a is 3. In certain embodiments, a is 1, 2, or 3 for a compound of Formula (X-C). In certain embodiments, a cannabinoid compound is of Formula (X-C), and a is 1, 2, 3, 4, or 5. In certain embodiments, a compound of Formula (X-C) is of Formula (8a):

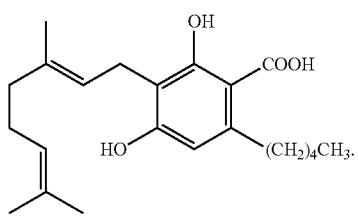

(8a)

In some embodiments, cannabinoids of the present disclosure comprise cannabinoid receptor ligands. Cannabinoid receptors are a class of cell membrane receptors in the G protein-coupled receptor superfamily. Cannabinoid receptors include the $CB_1$ receptor and the $CB_2$ receptor. In some embodiments, cannabinoid receptors comprise GPR18, GPR55, and PPAR. (See Bram et al. "Activation of GPR18 by cannabinoid compounds: a tale of biased agonism" Br J Pharmcol v171 (16) (2014); Shi et al. "The novel cannabinoid receptor GPR55 mediates anxiolytic-like effects in the medial orbital cortex of mice with acute stress" Molecular Brain 10, No. 38 (2017); and O'Sullvan, Elizabeth. "An update on PPAR activation by cannabinoids" Br J Pharmcol v. 173(12) (2016)).

In some embodiments, cannabinoids comprise endocannabinoids, which are substances produced within the body, and phytocannabinoids, which are cannabinoids that are naturally produced by plants of genus Cannabis. In some embodiments, phytocannabinoids comprise the acidic and decarboxylated acid forms of the naturally-occurring plant-derived cannabinoids, and their synthetic and biosynthetic equivalents.

Over 94 phytocannabinoids have been identified to date (Berman, Paula, et al. "A new ESI-LC/MS approach for comprehensive metabolic profiling of phytocannabinoids in Cannabis." Scientific reports 8.1 (2018): 14280; El-Alfy et al., 2010, "Antidepressant-like effect of delta-9-tetrahydrocannabinol and other cannabinoids isolated from Cannabis sativa L", Pharmacology Biochemistry and Behavior 95 (4): 434-42; Rudolf Brenneisen, 2007, Chemistry and Analysis of Phytocannabinoids, each of which is incorporated by reference in this application in its entirety). In some embodiments, cannabinoids comprise $\Delta^9$-tetrahydrocannabinol (THC) type (e.g., (−)-trans-delta-9-tetrahydrocannabinol or dronabinol, (+)-trans-delta-9-tetrahydrocannabinol, (−)-cis-delta-9-tetrahydrocannabinol, or (+)-cis-delta-9-tetrahydrocannabinol), cannabidiol (CBD) type, cannabigerol (CBG) type, cannabichromene (CBC) type, cannabicyclol (CBL) type, cannabinodiol (CBND) type, or cannabitriol (CBT) type cannabinoids, or any combination thereof (see, e.g., R Pertwee, ed, Handbook of Cannabis (Oxford, UK: Oxford University Press, 2014)), which is incorporated by reference in this application in its entirety). A non-limiting list of cannabinoids comprises: cannabiorcol-C1 (CBNO), CBND-C1 (CBNDO), $\Delta^9$-trans-Tetrahydrocannabiorcolic acid-C1 ($\Delta^9$-THCO), Cannabidiorcol-C1 (CBDO), Cannabiorchromene-C1 (CBCO), (−)-$\Delta^8$-trans-(6aR,10aR)-Tetrahydrocannabiorcol-C1 ($\Delta^8$-THCO), Cannabiorcyclol C1 (CBLO), CBG-C1 (CBGO), Cannabinol-C2 (CBN-C2), CBND-C2, $\Delta^9$-THC-C2, CBD-C2, CBC-C2, $\Delta^8$-THC-C2, CBL-C2, Bisnor-cannabielsoin-C1 (CBEO), CBG-C2, Cannabivarin-C3 (CBNV), Cannabinodivarin-C3 (CBNDV), (−)-$\Delta^9$-trans-Tetrahydrocannabivarin-C3 ($\Delta^9$-THCV), (−)-Cannabidivarin-C3 (CBDV), (±)-Cannabichromevarin-C3 (CBCV), (−)-$\Delta^8$-trans-THC-C3 ($\Delta^8$-THCV), (±)-(1aS,3aR, 8bR,8cR)-Cannabicyclovarin-C3 (CBLV), 2-Methyl-2-(4-methyl-2-pentenyl)-7-propyl-2H-1-benzopyran-5-ol, $\Delta^7$-tetrahydrocannabivarin-C3 ($\Delta^7$-THCV), CBE-C2, Cannabigerovarin-C3 (CBGV), Cannabitriol-C1 (CBTO), Cannabinol-C4 (CBN-C4), CBND-C4, (−)-$\Delta^9$-trans-Tetrahydrocannabinol-C4 ($\Delta^9$-THC-C4), Cannabidiol-C4 (CBD-C4), CBC-C4, (−)-trans-$\Delta^8$-THC-C4, CBL-C4, Cannabielsoin-C3 (CBEV), CBG-C4, CBT-C2, Cannabichromanone-C3, Cannabiglendol-C3 (OH-iso-HHCV-C3), Cannabioxepane-C5 (CBX), Dehydrocannabifuran-C5 (DCBF), Cannabinol-C5 (CBN), Cannabinodiol-C5 (CBND), (−)-$\Delta^9$-trans-Tetrahydrocannabinol-C5 ($\Delta^9$-THC), (−)-$\Delta^8$-trans-(6aR,10aR)-Tetrahydrocannabinol-C5 ($\Delta^8$-THC), (±)-Cannabichromene-C5 (CBC), (−)-Cannabidiol-C5 (CBD), (±)-(1aS,3aR,8bR,8cR)-CannabicyclolC5 (CBL), Cannabicitran-C5 (CBR), (−)-$\Delta^9$-(6aS,10aR-cis)-Tetrahydrocannabinol-C5 ((−)-cis-$\Delta^9$-THC), (−)-$\Delta^7$-trans-(1R,3R,6R)-Isotetrahydrocannabinol-C5 (trans-iso$\Delta^7$-THC), CBE-C4, Cannabigerol-C5 (CBG), Cannabitriol-C3 (CBTV), Cannabinol methyl ether-C5 (CBNM), CBNDM-C5, 8-OH-CBN-C5 (OH-CBN), OH-CBND-C5 (OH-CBND), 10-Oxo-$\Delta^{6a(10a)}$-Tetrahydrocannabinol-C5 (OTHC), Cannabichromanone D-C5, Cannabicoumaronone-C5 (CBCON-C5), Cannabidiol monomethyl ether-C5 (CBDM), $\Delta^9$-THCM-C5, (±)-3"-hydroxy-$\Delta^{4n}$-cannabichromene-C5, (5aS,6S,9R,9aR)-Cannabielsoin-C5 (CBE), 2-geranyl-5-hydroxy-3-n-pentyl-1,4-benzoquinone-C5, 5-geranyl olivetolic acid, 5-geranyl olivetolate, 8α-Hydroxy-$\Delta^9$-Tetrahydrocannabinol-C5 (8α-OH-$\Delta^9$-THC), 8β-Hydroxy-$\Delta^9$-Tetrahydrocannabinol-C5 (8β-OH-$\Delta^9$-THC), 10α-Hydroxy-$\Delta^8$-Tetrahydrocannabinol-C5 (10α-OH-$\Delta^8$-THC), 10β-Hydroxy-$\Delta^8$-Tetrahydrocannabinol-C5 (10β-OH-$\Delta^8$-THC), 10α-hydroxy-$\Delta^{9,11}$-hexahydrocannabinol-C5, 9β,10β-Epoxyhexahydrocannabinol-C5, OH-CBD-C5 (OH-CBD), Cannabigerol monomethyl ether-C5 (CBGM), Cannabichromanone-C5, CBT-C4, (±)-6,7-cis-epoxycannabigerol-C5, (±)-6,7-trans-epoxycannabigerol-C5, (−)-7-hydroxycannabichromane-C5, Cannabimovone-C5, (−)-trans-Cannabitriol-C5 ((−)-trans-CBT), (+)-trans-Cannabitriol-C5 ((+)-trans-CBT), (±)-cis-Cannabitriol-C5 ((±)-cis-CBT), (−)-trans-10-Ethoxy-9-hydroxy-$\Delta^{6a(10a)}$-tetrahydrocannabivarin-C3 [(−)-trans-CBT-OEt], (−)-(6aR,9S,10S,10aR)-9,10-Dihydroxyhexahydrocannabinol-C5 [(−)-Cannabiripsol] (CBR), Cannabichromanone C-C5, (−)-6a,7,10a-Trihydroxy-$\Delta^9$-tetrahydrocannabinol-C5 [(−)-Cannabitetrol] (CBTT), Cannabichromanone B-C5, 8,9-Dihydroxy-$\Delta^{6a(10a)\text{-}tetrahydrocannabinol\text{-}C}$5 (8,9-Di-OHCBT), (±)-4-acetoxycannabichromene-C5, 2-acetoxy-6-geranyl-3-n-pentyl-1,4-benzoquinone-C5, 11-Acetoxy-$\Delta$ 9-TetrahydrocannabinolC5 (11-OAc-$\Delta$ 9-THC), 5-acetyl-4-hydroxy-cannabigerol-C5, 4-acetoxy-2-geranyl-5-hydroxy-3-npentylphenol-C5, (−)-trans-10-Ethoxy-9-hydroxy-$\Delta^{6a(10a)}$-tetrahydrocannabinol-C5 ((−)-trans-CBTOEt), sesquicannabigerol-C5 (SesquiCBG), carmagerol-C5, 4-terpenyl cannabinolate-C5, β-fenchyl-$\Delta^9$-tetrahydrocannabinolate-C5, α-fenchyl-$\Delta^9$-tetrahydrocannabinolate-C5, epi-bornyl-$\Delta^9$-tetrahydrocannabinolate-C5, bornyl-$\Delta^9$-tetrahydrocannabinolate-C5, α-terpenyl-$\Delta^9$-tetrahydrocannabinolate-C5, 4-terpenyl-$\Delta^9$-tetrahydrocannabinolate-C5, 6,6,9-trimethyl-3-pentyl-6H-dibenzo[b,d]pyran-1-ol, 3-(1,1-dimethylheptyl)-6,6a,7,8,10,10a-hexahydro-1-hydroxy-6,6-dimethyl-9H-dibenzo[b,d]pyran-9-one, (−)-(3S,4S)-7-hydroxy-$\Delta^6$-tetrahydrocannabinol-1,1-dimethylheptyl, (+)-(3 S,4S)-7-hydroxy-$\Delta^6$-tetrahydrocannabinol-1,1-dimethylheptyl, 11-hydroxy-$\Delta^9$-tetrahydrocannabinol, and $\Delta^8$-tetrahydrocannabinol-11-oic acid)); certain piperidine analogs (e.g., (−)-(6S,6aR,9R,10aR)-5,6,6a,7,8,9,10,10a-octahydro-6-methyl-3-[(R)-1-methyl-4-phenylbutoxy]-1,9-phenanthridinediol 1-acetate)), certain aminoalkylindole analogs (e.g., (R)-(+)-[2,3-dihydro-5-methyl-3-(4-morpholinylmethyl)-pyrrolo[1,2,3-de]-1,4-benzoxazin-6-yl]-1-naphthalenyl-methanone), certain open pyran ring analogs (e.g., 2-[3-methyl-6-(1-methylethenyl)-2-cyclohexen-1-yl]-5-pentyl-1,3-benzenediol and 4-(1,1-dimethylheptyl)-2,3'-dihydroxy-6'alpha-(3-hydroxypropyl)-1',2',3',4',5',6'-hexahydrobiphenyl, tetrahydrocannabiphorol (THCP), cannabidiphorol (CBDP), CBGP, CBCP, their acidic forms, salts of the acidic forms, or any combination thereof.

A cannabinoid described in this application can be a rare cannabinoid. For example, in some embodiments, a cannabinoid described in this application corresponds to a cannabinoid that is naturally produced in conventional *Cannabis* varieties at concentrations of less than 10%, 9%, 8%, 7%, 6%, 5%, 4%, 3%, 2%, 1%, 0.9%, 0.8%, 0.7%, 0.6%, 0.5%, 0.25%, or 0.1% by dry weight of the female flower. In some embodiments, rare cannabinoids include CBGA, CBGVA, THCVA, CBDVA, CBCVA, and CBCA. In some embodiments, rare cannabinoids are cannabinoids that are not THCA, THC, CBDA or CBD.

A cannabinoid described in this application can also be a non-rare cannabinoid.

In some embodiments, the cannabinoid is selected from the cannabinoids listed in Table 1.

TABLE 1

Non-limiting examples of cannabinoids according to the present disclosure.

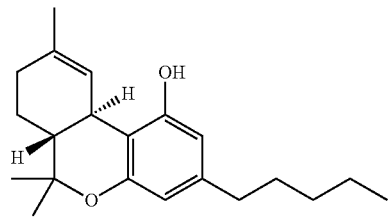

$\Delta^9$-Tetrahydrocannabinol
$\Delta^9$-THC-C$_5$

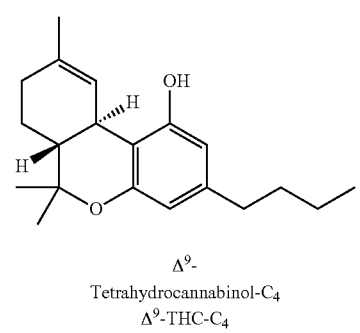 [SMILES: CCCCc1cc(O)c2c(c1)OC(C)(C)[C@@H]1CCC(C)=C[C@@H]21]

$\Delta^9$-Tetrahydrocannabinol-C$_4$
$\Delta^9$-THC-C$_4$

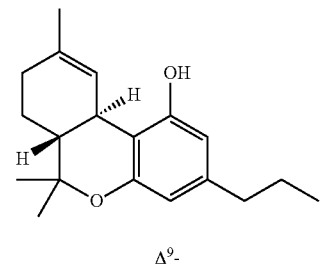

$\Delta^9$-Tetrahydrocannabivarin
$\Delta^9$-THCV-C$_3$

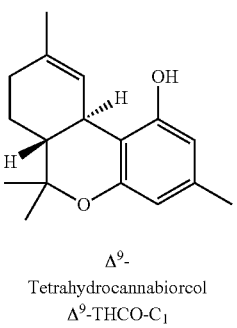

$\Delta^9$-Tetrahydrocannabiorcol
$\Delta^9$-THCO-C$_1$

TABLE 1-continued

Non-limiting examples of cannabinoids according to the present disclosure.

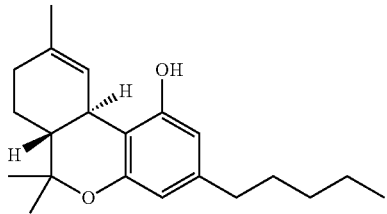

(-)-(6aS,10aR)-Δ$^9$-
Tetrahydrocannabinol
(-)-cis-Δ$^9$-THC-C$_5$

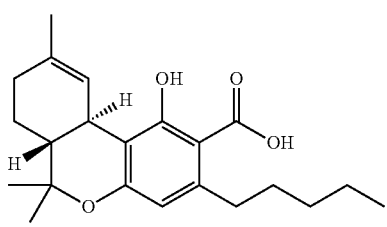

Δ$^9$-Tetrahydro-
cannabinolic acid A
Δ$^9$-THCA-C$_5$A

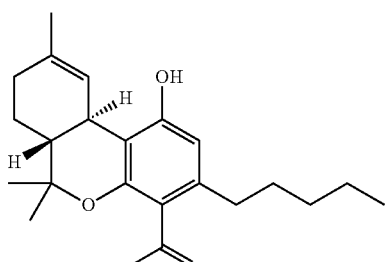

Δ$^9$-Tetrahydro-
cannabinolic acid B
Δ$^9$-THCA-C$_5$B

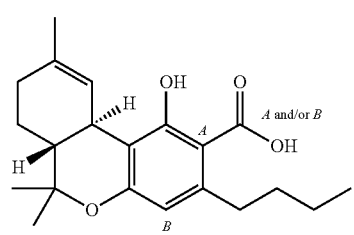

Δ$^9$-Tetrahydro-
cannabinolic acid-C$_4$
A and/or B
Δ$^9$-THCA-C$_4$ A and/or B TABLE 1-continued Non-limiting examples of cannabinoids according to the present disclosure.

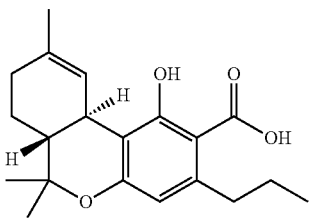

Δ$^9$-Tetrahydro-
cannabivarinic acid A
Δ$^9$-THCVA-C$_3$A

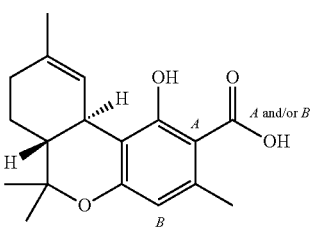

Δ$^9$-Tetrahydro-
cannabiorcolic acid-
A and/or B
Δ$^9$-THCOA-C$_1$A
and/or B

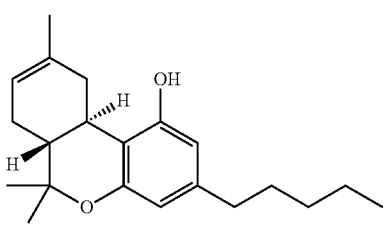

(-)-Δ$^8$-trans-
(6aR,10aR)-
Δ$^8$-
Tetrahydrocannabinol
Δ$^8$-THC-C$_5$

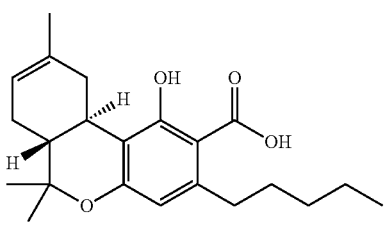

(-)-Δ$^8$-trans-
(6aR,10aR)-
Tetrahydrocannabinolic
acid A
Δ$^8$-THCA-C$_5$A

TABLE 1-continued

Non-limiting examples of cannabinoids according to the present disclosure.

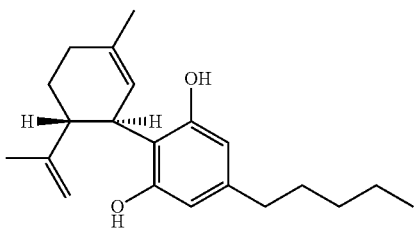

(-)-Cannabidiol
CBD-C5

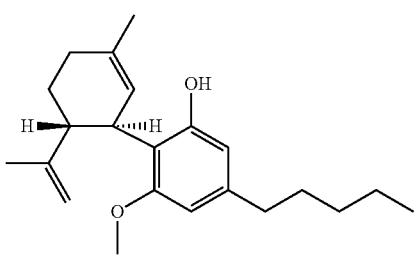

Cannabidiol
monomethyl ether
CBDM-C5

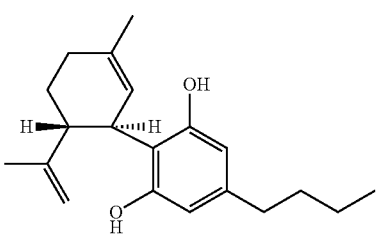

Cannabidiol-C4
CBD-C4

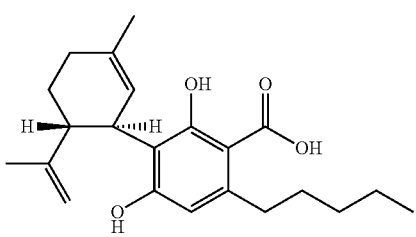

Cannabidiolic acid
CBDA-C5

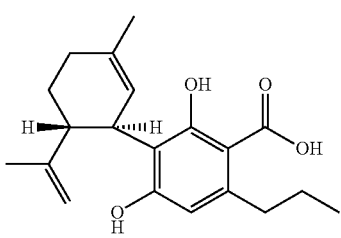

Cannabidivarinic acid
CBDVA-C3

TABLE 1-continued

Non-limiting examples of cannabinoids according to the present disclosure.

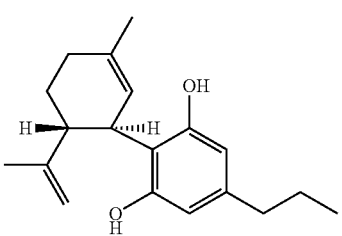

(-)-Cannabidivarin
CBDV-C3

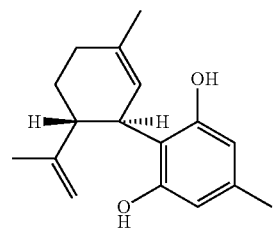

Cannabidiorcol
CBD-C1

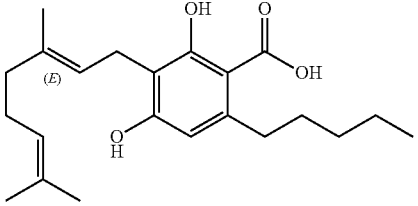

Cannabigerolic acid A
(E)-CBGA-$C_5$ A

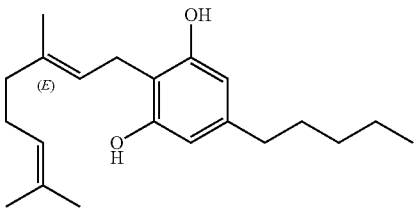

Cannabigerol
(E)-CBG-$C_5$

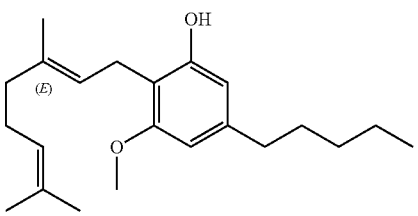

Cannabigerol
monomethyl ether
(E)-CBGM-$C_5$ A

TABLE 1-continued

Non-limiting examples of cannabinoids according to the present disclosure.

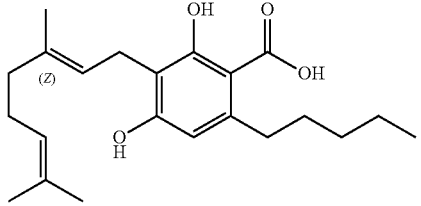

Cannabinerolic acid A
(Z)-CBGA-C₅ A

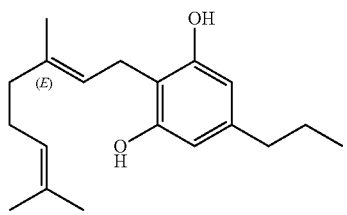

Cannabigerovarin
(E)-CBGV-C₃

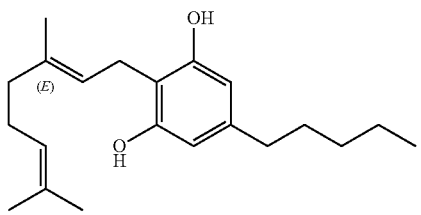

Cannabigerol
(E)-CBG-C₅

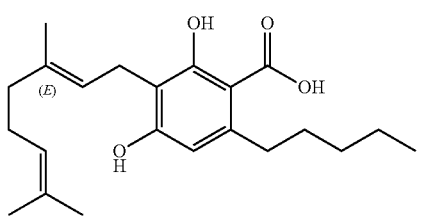

Cannabigerolic acid A
(E)-CBGA-C₅ A

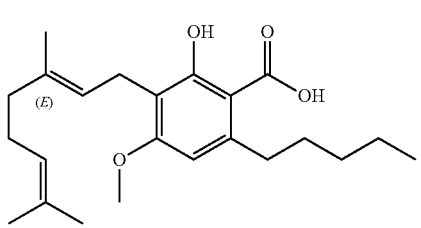

Cannabigerolic acid A
monomethyl ether
(E)-CBGAM-C₅ A

TABLE 1-continued

Non-limiting examples of cannabinoids according to the present disclosure.

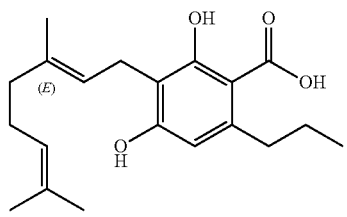

Cannabigerovarinic acid A
(E)-CBGVA-C₃ A

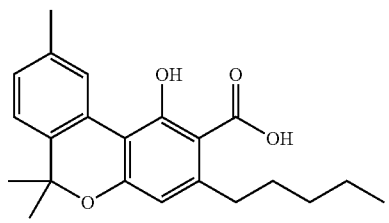

Cannabinolic acid A
CBNA-C5 A

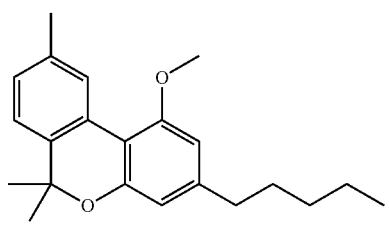

Cannabinol methyl ether
CBNM-C5

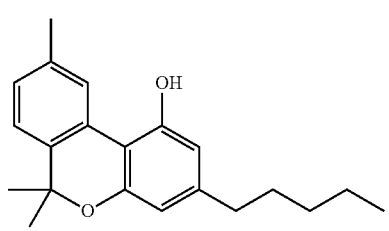

Cannabinol
CBN-C5

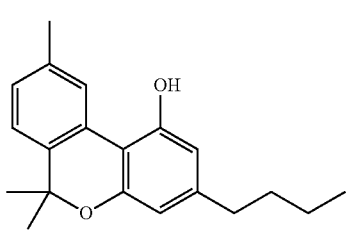

Cannabinol-C4
CBN-C4

TABLE 1-continued

Non-limiting examples of cannabinoids according to the present disclosure.

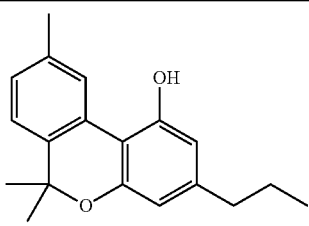

Cannabivarin
CBN-C3

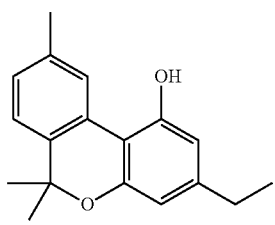

Cannabinol-C2
CBN-C2

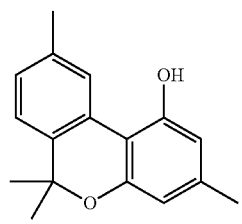

Cannabiorcol
CBN-C1

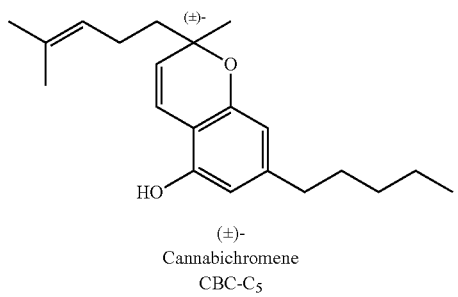 [SMILES: CCCCCc1cc(O)c2c(c1)OC(C)(CCC=C(C)C)C=C2]

(±)-Cannabichromene
CBC-C5

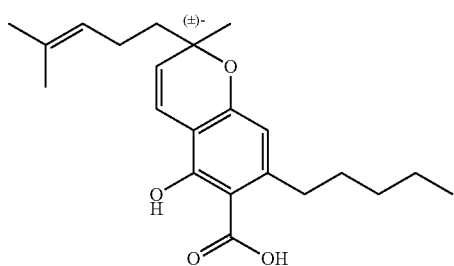

(±)-Cannabichromenic
acid A
CBCA-C5 A

TABLE 1-continued

Non-limiting examples of cannabinoids according to the present disclosure.

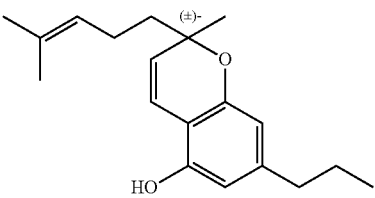

(±)-Cannabivarichromene,
(±)-Cannabichromevarin
CBCV-C3

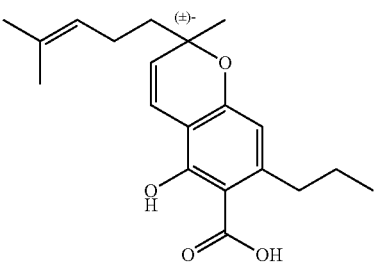

(±)-Cannabichromevarinic
acid A
CBCVA-C3 A

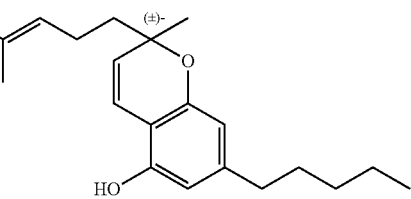

(±)-Cannabichromene
CBC-C5

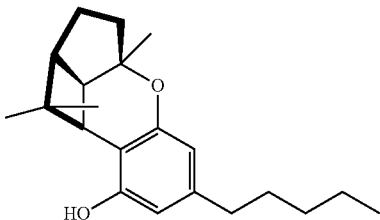

(±)-(1aS,3aR,8bR,8cR)-
Cannabicyclol
CBL-C5

TABLE 1-continued

Non-limiting examples of cannabinoids according to the present disclosure.

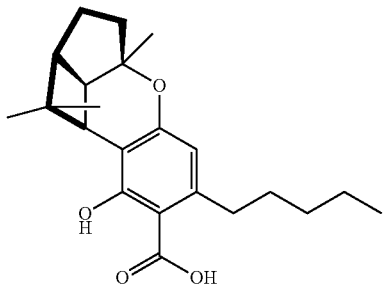

(±)-
(1aS,3aR,8bR,8cR)-
Cannabicyclolic acid A
CBLA-C5A

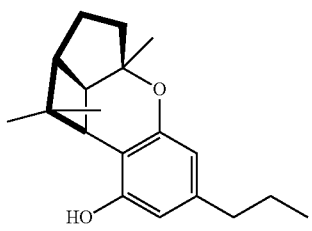

(±)-
(1aS,3aR,8bR,8cR)-
Cannabicyclovarin
CBLV-C3

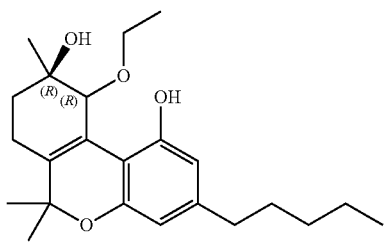

(−)-(9R,10R)-trans-
10-O-Ethyl-
cannabitriol
(−)-trans-CBT-OEt-C5

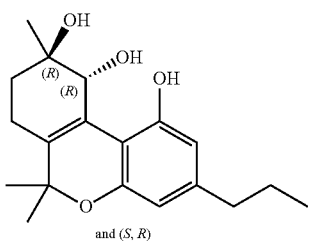

and (S, R)

(±)-(9R,10R/9S,10S)-
Cannabitriol-C3
(±)-trans-CBT-C3

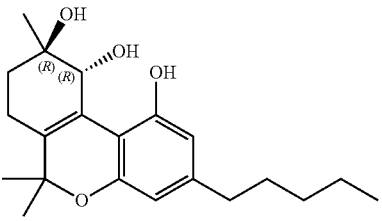

(−)-(9R,10R)-trans-
Cannabitriol
(−)-trans-CBT-C5

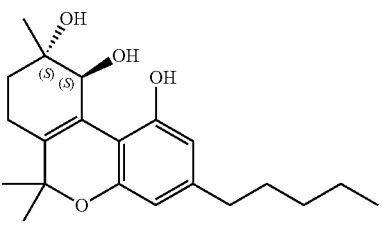

(+)-(9S,10S)-
Cannabitriol
(+)-trans-CBT-C5

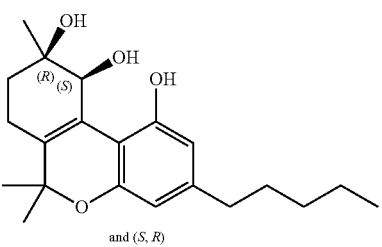

and (S, R)

(±)-(9R,10S/9S,10R)-
Cannabitriol
(±)-cis-CBT-C5

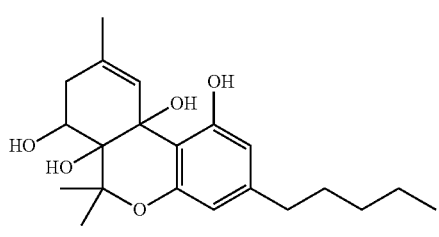

(−)-6a,7,10a-
Trihydroxy-
Δ9-
tetrahydrocannabinol
(−)-Cannabitetrol

TABLE 1-continued

Non-limiting examples of cannabinoids according to the present disclosure.

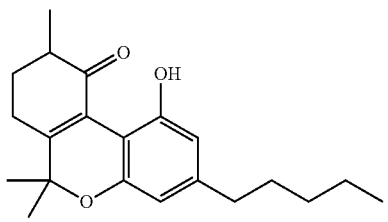

10-Oxo-Δ6a(10a)-
tetrahydrocannabinol
OTHC

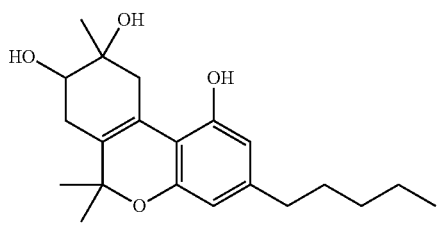

8,9-Dihydroxy-
Δ6a(10a)-
tetrahydrocannabinol
8,9-Di-OH-CBT-C5

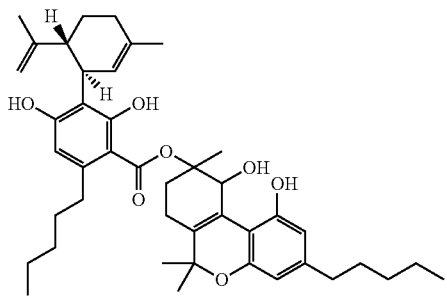

Cannabidiolic acid A
cannabitriol ester
CBDA-C5 9-OH-CBT-C5
ester

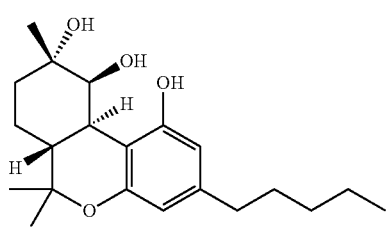

(-)-(6aR,9S,10S,10aR)-
9,10-Dihydroxy-
hexahydrocannabinol,
Cannabiripsol
Cannabiripsol-C5

TABLE 1-continued

Non-limiting examples of cannabinoids according to the present disclosure.

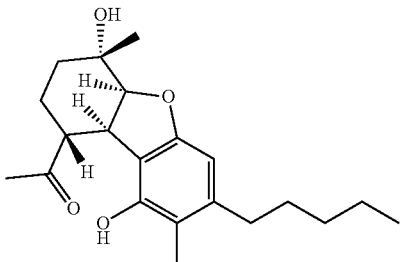

(5aS,6S,9R,9aR)-
Cannabielsoic acid B
CBEA-C5 B

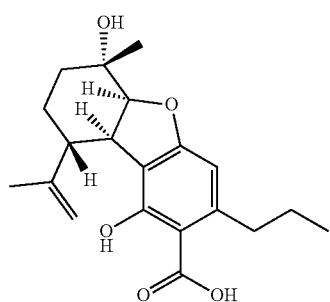

(5aS,6S,9R,9aR)-
C3-Cannabielsoic
acid B
CBEA-C3 B

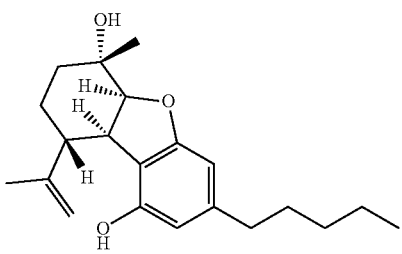

(5aS,6S,9R,9aR)-
Cannabielsoin
CBE-C5

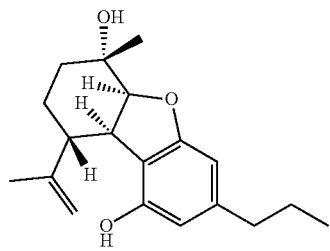

(5aS,6S,9R,9aR)-
C3-Cannabielsoin
CBE-C3

TABLE 1-continued

Non-limiting examples of cannabinoids according to the present disclosure.

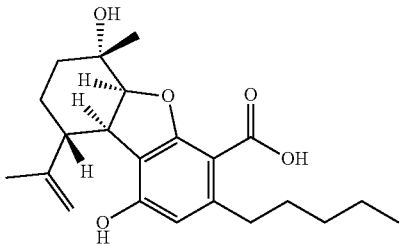

(5aS,6S,9R,9aR)-
Cannabielsoic acid A
CBEA-C5 A

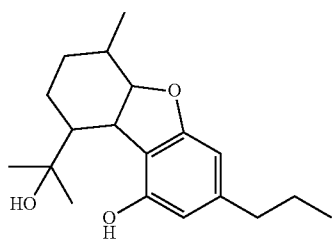

Cannabiglendol-C3
OH-iso-HHCV-C3

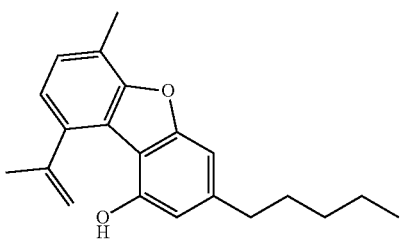

Dehydrocannabifuran
DCBF-C5

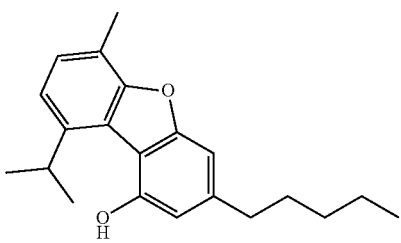

Cannabifuran
CBF-C5

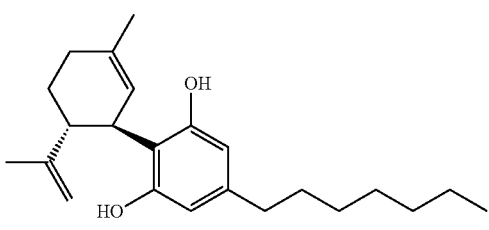

Cannabidiphorol
(CBDP)

TABLE 1-continued

Non-limiting examples of cannabinoids according to the present disclosure.

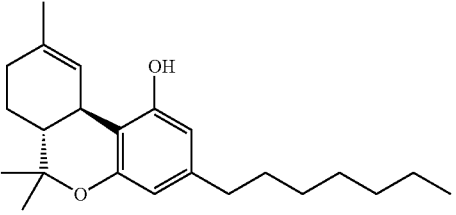

Tetrahydrocannabiphorol
(THCP)

Biosynthesis of Cannabinoids and Cannabinoid Precursors

Aspects of the present disclosure provide tools, sequences, and methods for the biosynthetic production of cannabinoids in host cells. In some embodiments, the present disclosure teaches expression of enzymes that are capable of producing cannabinoids by biosynthesis.

Figure 1:
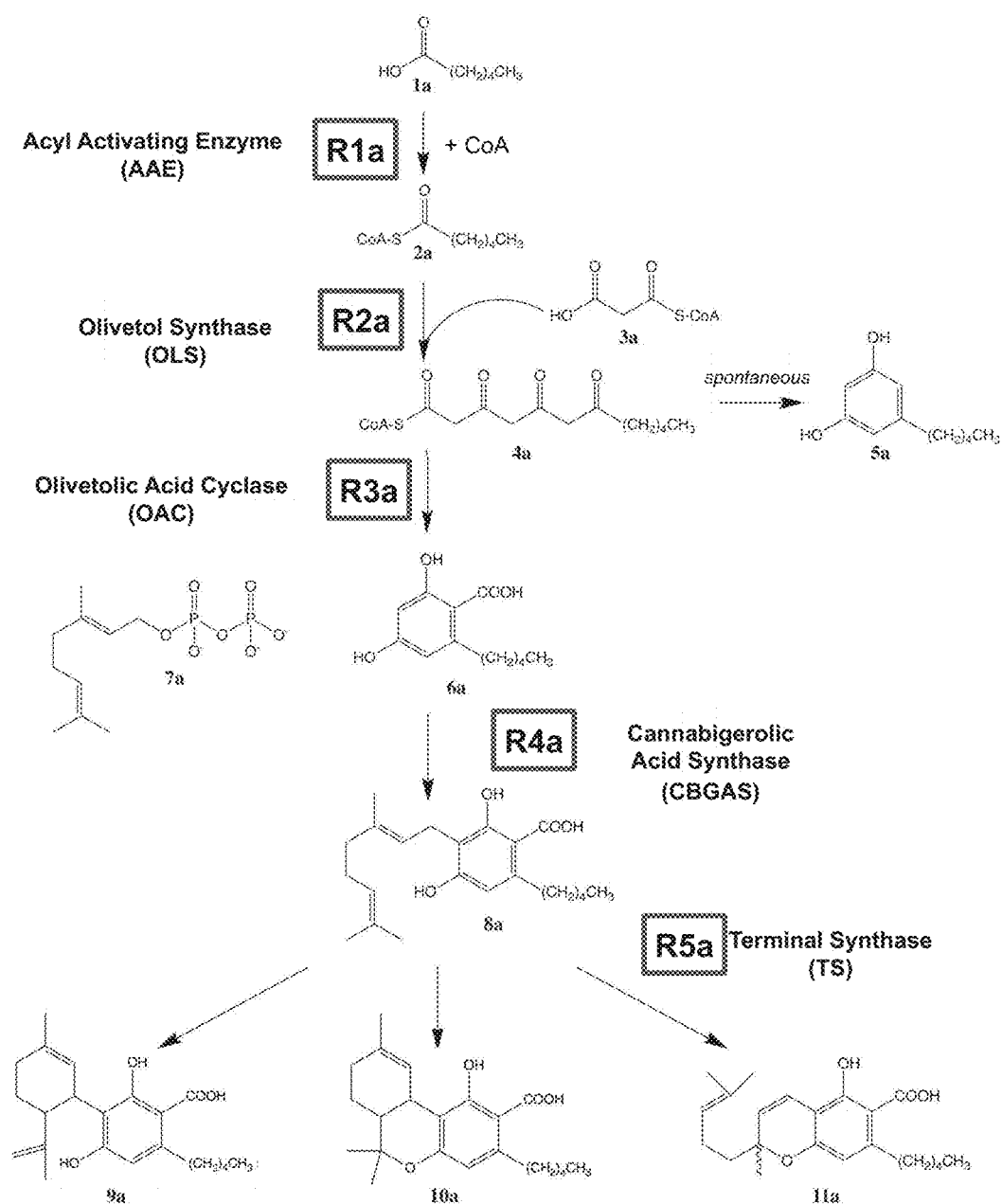
Figure 2:
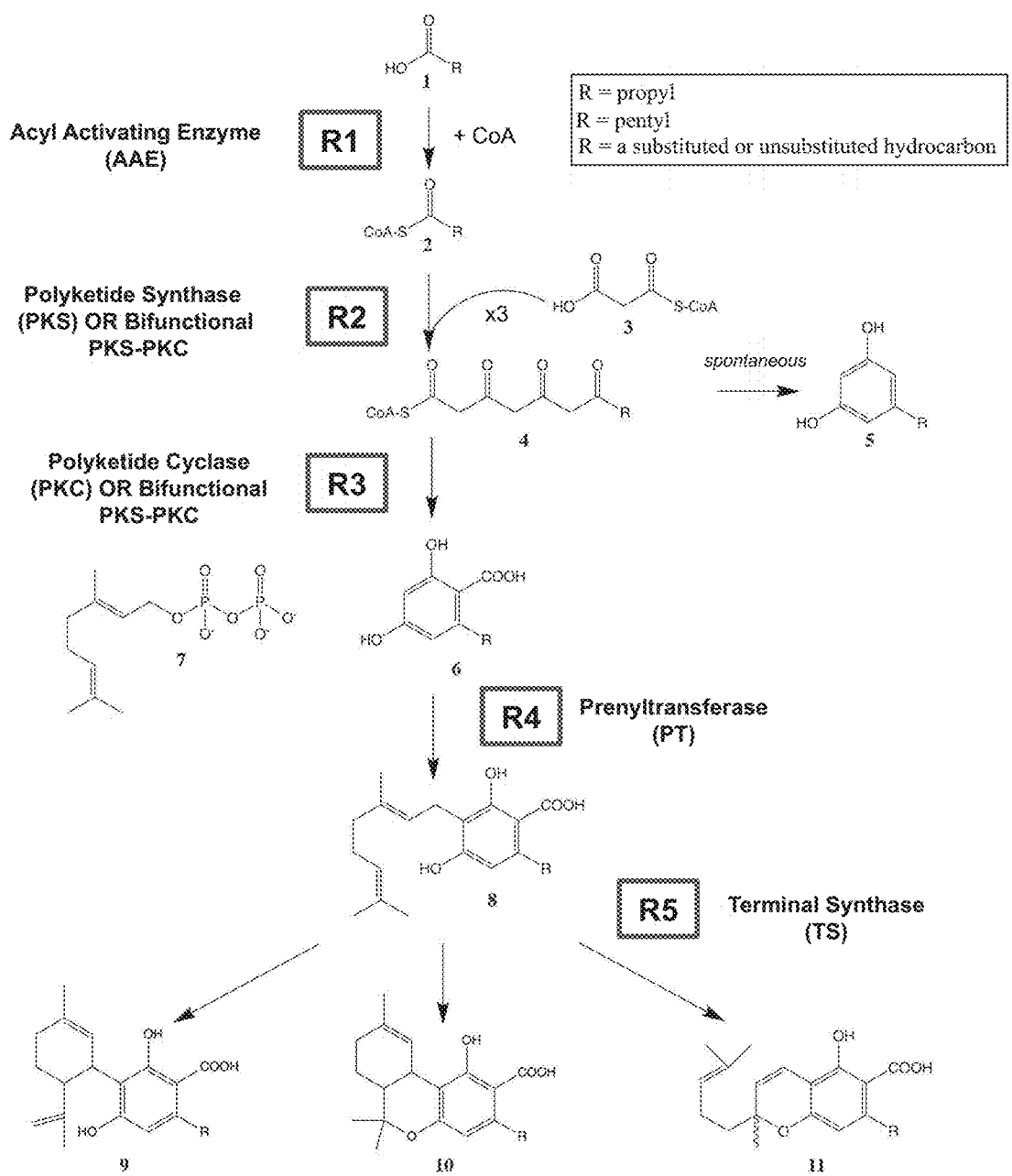
FIG. 2 is a schematic depicting a heterologous biosynthetic pathway for production of cannabinoid compounds, including five enzymatic steps mediated by: (R1) acyl activating enzymes (AAE); (R2) polyketide synthase enzymes (PKS) or bifunctional polyketide synthase-polyketide cyclase enzymes (PKS-PKC); (R3) polyketide cyclase enzymes (PKC) or bifunctional PKS-PKC enzymes; (R4) prenyltransferase enzymes (PT); and (R5) terminal synthase enzymes (TS). Any carboxylic acid of varying chain lengths, structures (e.g., aliphatic, alicyclic, or aromatic) and functionalization (e.g., hydroxylic-, keto-, amino-, thiol-, aryl-, or alogeno-) may also be used as precursor substrates (e.g., thiopropionic acid, hydroxy phenyl acetic acid, norleucine, bromodecanoic acid, butyric acid, isovaleric acid, octanoic acid, decanoic acid, etc).

As a non-limiting example, one or more of the enzymes depicted in FIG. 2 may be used to produce a cannabinoid or cannabinoid precursor of interest. FIG. 1 shows a cannabinoid biosynthesis pathway for the most abundant phytocannabinoids found in *Cannabis*. See also, de Meijer et al. I, II, III, and IV (I: 2003, *Genetics*, 163:335-346; II: 2005, *Euphytica*, 145:189-198; III: 2009, *Euphytica*, 165:293-311; and IV: 2009, *Euphytica*, 168:95-112), and Carvalho et al. "Designing Microorganisms for Heterologous Biosynthesis of Cannabinoids" (2017) *FEMS Yeast Research* June 1; 17(4), each of which is in this application incorporated by reference in its entirety for all purposes.

It should be appreciated that a precursor substrate for use in cannabinoid biosynthesis is generally selected based on the cannabinoid of interest. Non-limiting examples of cannabinoid precursors include compounds of Formulae 1-8 in FIG. 2. In some embodiments, polyketides, including compounds of Formula 5, could be prenylated. In certain embodiments, the precursor is a precursor compound shown in FIG. 1, 2, or 3. Substrates containing 1-40 carbon atoms are preferred. In some embodiments, substrates containing 3-8 carbon atoms are most preferred.

As used in this application, a cannabinoid or a cannabinoid precursor may comprise an R group. See, e.g., FIG. 2. In some embodiments, R may be a hydrogen. In certain embodiments, R is optionally substituted alkyl. In certain embodiments, R is optionally substituted C1-40 alkyl. In certain embodiments, R is optionally substituted C2-40 alkyl. In certain embodiments, R is optionally substituted C2-40 alkyl, which is straight chain or branched alkyl. In certain embodiments, R is optionally substituted C3-8 alkyl. In certain embodiments, R is optionally substituted C1-C40 alkyl, C1-C20 alkyl, C1-C10 alkyl, C1-C8 alkyl, C1-C5 alkyl, C3-C5 alkyl, C3 alkyl, or C5 alkyl. In certain embodiments, R is optionally substituted C1-C20 alkyl. In certain embodiments, R is optionally substituted C1-C10 alkyl. In certain embodiments, R is optionally substituted C1-C8 alkyl. In certain embodiments, R is optionally substituted C1-C5 alkyl. In certain embodiments, R is optionally substituted C1-C7 alkyl. In certain embodiments, R is optionally substituted C3-C5 alkyl. In certain embodiments, R is optionally substituted C3 alkyl. In certain embodiments, R is unsubstituted C3 alkyl. In certain embodiments, R is n-C3 alkyl. In certain embodiments, R is n-propyl. In certain embodiments, R is n-butyl. In certain embodiments, R is n-pentyl. In certain embodiments, R is n-hexyl. In certain embodiments, R is n-heptyl. In certain embodiments, R is of formula:

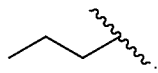 [SMILES: *CCC]

In certain embodiments, R is optionally substituted C4 alkyl. In certain embodiments, R is unsubstituted C4 alkyl. In certain embodiments, R is optionally substituted C5 alkyl. In certain embodiments, R is unsubstituted C5 alkyl. In certain embodiments, R is optionally substituted C6 alkyl. In certain embodiments, R is unsubstituted C6 alkyl. In certain embodiments, R is optionally substituted C7 alkyl. In certain embodiments, R is unsubstituted C7 alkyl. In certain embodiments, R is of formula:

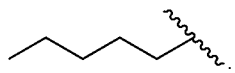 [SMILES: *CCCCC]

In certain embodiments, R is of formula:

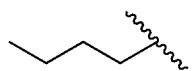

In certain embodiments, R is of formula:

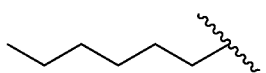

In certain embodiments, R is of formula:

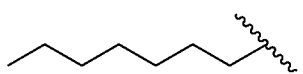

In certain embodiments, R is of formula:

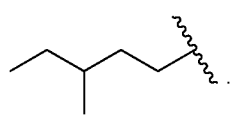 [SMILES: *CCC(C)CC]

In certain embodiments, R is optionally substituted n-propyl. In certain embodiments, R is n-propyl optionally substituted with optionally substituted aryl. In certain embodiments, R is n-propyl optionally substituted with optionally substituted phenyl. In certain embodiments, R is n-propyl substituted with unsubstituted phenyl. In certain embodiments, R is optionally substituted butyl. In certain embodiments, R is optionally substituted n-butyl. In certain embodiments, R is n-butyl optionally substituted with optionally substituted aryl. In certain embodiments, R is n-butyl optionally substituted with optionally substituted phenyl. In certain embodiments, R is n-butyl substituted with unsubstituted phenyl. In certain embodiments, R is optionally substituted pentyl. In certain embodiments, R is optionally substituted n-pentyl. In certain embodiments, R is n-pentyl optionally substituted with optionally substituted aryl. In certain embodiments, R is n-pentyl optionally substituted with optionally substituted phenyl. In certain embodiments, R is n-pentyl substituted with unsubstituted phenyl. In certain embodiments, R is optionally substituted hexyl. In certain embodiments, R is optionally substituted n-hexyl. In certain embodiments, R is optionally substituted n-heptyl. In certain embodiments, R is optionally substituted n-octyl. In certain embodiments, R is alkyl optionally substituted with aryl (e.g., phenyl). In certain embodiments, R is optionally substituted acyl (e.g, —C(=O)Me).

In certain embodiments, R is optionally substituted alkenyl (e.g, substituted or unsubstituted $C_{2-6}$ alkenyl). In certain embodiments, R is substituted or unsubstituted $C_{2-6}$ alkenyl. In certain embodiments, R is substituted or unsubstituted $C_{2-5}$ alkenyl. In certain embodiments, R is of formula:

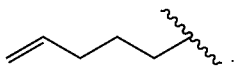 [SMILES: *CCCC=C]

In certain embodiments, R is optionally substituted alkynyl (e.g, substituted or unsubstituted $C_{2-6}$ alkynyl). In certain embodiments, R is substituted or unsubstituted $C_{2-6}$ alkynyl. In certain embodiments, R is of formula:

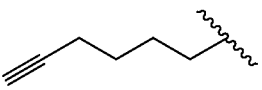

In certain embodiments, R is optionally substituted carbocyclyl. In certain embodiments, R is optionally substituted aryl (e.g., phenyl or napthyl).

The chain length of a precursor substrate can be from C1-C40. Those substrates can have any degree and any kind of branching or saturation or chain structure, including, without limitation, aliphatic, alicyclic, and aromatic. In addition, they may include any functional groups including hydroxy, halogens, carbohydrates, phosphates, methyl-containing or nitrogen-containing functional groups.

Figure 3:
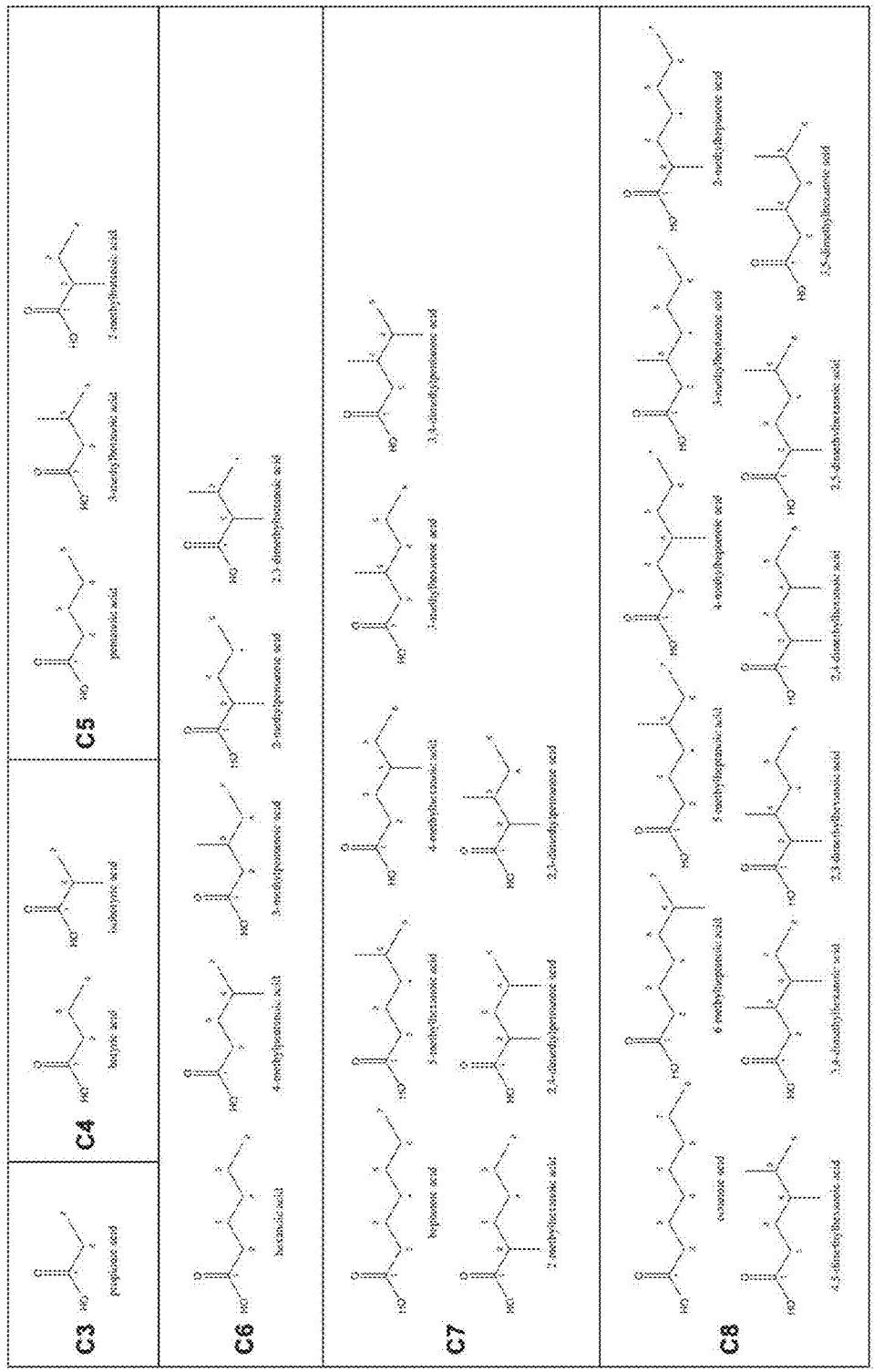
FIG. 3 is a non-exclusive representation of select putative precursors for the cannabinoid pathway in FIG. 2.

For example, FIG. 3 shows a non-exclusive set of putative precursors for the cannabinoid pathway. Aliphatic carboxylic acids including four to eight total carbons ("C4"-"C8" in FIG. 3) and up to 10-12 total carbons with either linear or branched chains may be used as precursors for the heterologous pathway. Non-limiting examples include methanoic acid, butyric acid, pentanoic acid, hexanoic acid, heptanoic acid, isovaleric acid, octanoic acid, and decanoic acid. Additional precursors may include ethanoic acid and propanoic acid. In some embodiments, in addition to acids, the ester, salt, and acid forms may all be used as substrates. Substrates may have any degree and any kind of branching, saturation, and chain structure, including, without limitation, aliphatic, alicyclic, and aromatic. In addition, they may include any functional modifications or combination of modifications including, without limitation, halogenation, hydroxylation, amination, acylation, alkylation, phenylation, and/or installation of pendant carbohydrates, phosphates, sulfates, heterocycles, or lipids, or any other functional groups.

Substrates for any of the enzymes disclosed in this application may be provided exogenously or may be produced endogenously by a host cell. In some embodiments, the cannabinoids are produced from a glucose substrate, so that compounds of Formula 1 shown in FIG. 2 and CoA precursors are synthesized by the cell. In other embodiments, a precursor is fed into the reaction. In some embodiments, a precursor is a compound selected from Formulae 1-8 in FIG. 2.

Cannabinoids produced by methods disclosed in this application include rare cannabinoids. Due to the low concentrations at which rare cannabinoids occur in nature, producing industrially significant amounts of isolated or purified rare cannabinoids from the *Cannabis* plant may become prohibitive due to, e.g., the large volumes of *Cannabis* plants, and the large amounts of space, labor, time, and capital requirements to grow, harvest, and/or process the plant materials. The disclosure provided in this application represents a potentially efficient method for producing high yields of cannabinoids, including rare cannabinoids.

Cannabinoids produced by the disclosed methods also include non-rare cannabinoids. Without being bound by a particular theory, the methods described in this application may be advantageous compared with traditional plant-based methods for producing non-rare cannabinoids. For example, methods provided in this application represent potentially efficient means for producing consistent and high yields of non-rare cannabinoids. With traditional methods of cannabinoid production, in which cannabinoids are harvested from plants, maintaining consistent and uniform conditions, including airflow, nutrients, lighting, temperature, and humidity, can be difficult. For example, with plant-based methods, there can be microclimates created by branching, which can lead to inconsistent yields and by-product formation. In some embodiments, the methods described in this application are more efficient at producing a cannabinoid of interest as compared to harvesting cannabinoids from plants. For example, with plant-based methods, seed-to-harvest can take up to half a year, while cutting-to-harvest usually takes about 4 months. Additional steps including drying, curing, and extraction are also usually needed with plant-based methods. In contrast, in some embodiments, the fermentation-based methods described in this application only take about 1, 2, 3, 4, 5, 6, 7, 8, 9, or 10 days. In some embodiments, the fermentation-based methods described in this application only take about 3-5 days. In some embodiments, the fermentation-based methods described in this application only take about 5 days. In some embodiments, the methods provided in this application reduce the amount of security needed to comply with regulatory standards. For example, a smaller secured area may be needed to be monitored and secured to practice the methods described in this application as compared to the cultivation of plants. In some embodiments, the methods described in this application are advantageous over plant-sourced cannabinoids.

Cannabinoid Pathway Enzymes

Methods for production of cannabinoids and cannabinoid precursors can include expression of one or more of: an acyl activating anzyme (AAE); a polyketide synthase (PKS) (e.g., OLS); a polyketide cyclase (PKC); a prenyltransferase (PT) and a terminal synthase (TS).

Acyl Activating Enzyme (AAE)

A host cell described in this disclosure may comprise an AAE. As used in this disclosure, an AAE refers to an enzyme that is capable of catalyzing the esterification between a thiol and a substrate (e.g., optionally substituted aliphatic or aryl group) that has a carboxylic acid moiety. In some embodiments, an AAE is capable of using Formula (1):

(1)

or a salt, solvate, hydrate, polymorph, co-crystal, tautomer, stereoisomer, isotopically labeled derivative thereof to produce a product of Formula (2):

(2)

R is as defined in this application. In certain embodiments, R is hydrogen. In certain embodiments, R is optionally substituted alkyl. In certain embodiments, R is optionally substituted C1-40 alkyl. In certain embodiments, R is optionally substituted C2-40 alkyl. In certain embodiments, R is optionally substituted C2-40 alkyl, which is straight chain or branched alkyl. In certain embodiments, R is optionally substituted C2-10 alkyl, optionally substituted C10-C20 alkyl, optionally substituted C20-C30 alkyl, optionally substituted C30-C40 alkyl, or optionally substituted C40-C50 alkyl, which is straight chain or branched alkyl. In certain embodiments, R is optionally substituted C3-8 alkyl. In certain embodiments, R is optionally substituted C1-C40 alkyl, C1-C20 alkyl, C1-C10 alkyl, C1-C8 alkyl, C1-C5 alkyl, C3-C5 alkyl, C3 alkyl, or C5 alkyl. In certain embodiments, R is optionally substituted C1-C20 alkyl. In certain embodiments, R is optionally substituted C1-C20 branched alkyl. In certain embodiments, R is optionally substituted C1-C20 alkyl, optionally substituted C1-C10 alkyl, optionally substituted C10-C20 alkyl, optionally substituted C20-C30 alkyl, optionally substituted C30-C40 alkyl, or optionally substituted C40-C50 alkyl. In certain embodiments, R is optionally substituted C1-C10 alkyl. In certain embodiments, R is optionally substituted C3 alkyl. In certain embodiments, R is optionally substituted n-propyl. In certain embodiments, R is unsubstituted n-propyl. In certain embodiments, R is optionally substituted C1-C8 alkyl. In some embodiments, R is a C2-C6 alkyl. In certain embodiments, R is optionally substituted C1-C5 alkyl. In certain embodiments, R is optionally substituted C3-C5 alkyl. In certain embodiments, R is optionally substituted C3 alkyl. In certain embodiments, R is optionally substituted C5 alkyl. R is of formula:

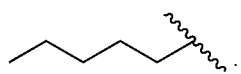 [SMILES: *CCCCC]

In certain embodiments, R is of formula:

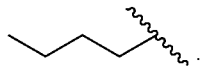 [SMILES: *CCCC]

In certain embodiments, R is of formula:

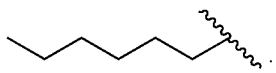 [SMILES: *CCCCCC]

In certain embodiments, R is of formula:

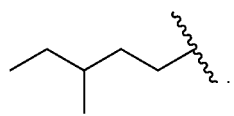 [SMILES: *CCC(C)CC]

In certain embodiments, R is optionally substituted propyl. In certain embodiments, R is optionally substituted n-propyl. In certain embodiments, R is n-propyl optionally substituted with optionally substituted aryl. In certain embodiments, R is n-propyl optionally substituted with optionally substituted phenyl. In certain embodiments, R is n-propyl substituted with unsubstituted phenyl. In certain embodiments, R is optionally substituted butyl. In certain embodiments, R is optionally substituted n-butyl. In certain embodiments, R is n-butyl optionally substituted with optionally substituted aryl. In certain embodiments, R is n-butyl optionally substituted with optionally substituted phenyl. In certain embodiments, R is n-butyl substituted with unsubstituted phenyl. In certain embodiments, R is optionally substituted pentyl. In certain embodiments, R is optionally substituted n-pentyl. In certain embodiments, R is n-pentyl optionally substituted with optionally substituted aryl. In certain embodiments, R is n-pentyl optionally substituted with optionally substituted phenyl. In certain embodiments, R is n-pentyl substituted with unsubstituted phenyl. In certain embodiments, R is optionally substituted hexyl. In certain embodiments, R is optionally substituted n-hexyl. In certain embodiments, R is optionally substituted n-heptyl. In certain embodiments, R is optionally substituted n-octyl. In certain embodiments, R is alkyl optionally substituted with aryl (e.g., phenyl). In certain embodiments, R is optionally substituted acyl (e.g., —C(=O)Me).

In certain embodiments, R is optionally substituted alkenyl (e.g, substituted or unsubstituted $C_{2-6}$ alkenyl). In certain embodiments, R is substituted or unsubstituted $C_{2-6}$ alkenyl. In certain embodiments, R is substituted or unsubstituted $C_{2-5}$ alkenyl. In certain embodiments, R is of formula:

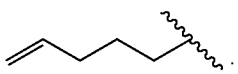 [SMILES: *CCCC=C]

In certain embodiments, R is optionally substituted alkynyl (e.g, substituted or unsubstituted $C_{2-6}$ alkynyl). In certain embodiments, R is substituted or unsubstituted $C_{2-6}$ alkynyl. In certain embodiments, R is of formula:

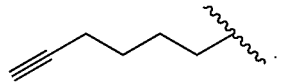 [SMILES: *CCCCC#C]

In certain embodiments, R is optionally substituted carbocyclyl. In certain embodiments, R is optionally substituted aryl (e.g., phenyl or napthyl).

In some embodiments, a substrate for an AAE is produced by fatty acid metabolism within a host cell. In some embodiments, a substrate for an AAE is provided exogenously.

In some embodiments, an AAE is capable of catalyzing the formation of hexanoyl-coenzyme A (hexanoyl-CoA) from hexanoic acid and coenzyme A (CoA). In some embodiments, an AAE is capable of catalyzing the formation of butanoyl-coenzyme A (butanoyl-CoA) from butanoic acid and coenzyme A (CoA).

As one of ordinary skill in the art would appreciate, an AAE could be obtained from any source, including naturally occurring sources and synthetic sources (e.g., a non-naturally occurring AAE). In some embodiments, an AAE is a *Cannabis* enzyme. Non-limiting examples of AAEs include *C. sativa* hexanoyl-CoA synthetase 1 (CsHCS1) and *C. sativa* hexanoyl-CoA synthetase 2 (CsHCS2) as disclosed in U.S. Pat. No. 9,546,362, which is incorporated by reference in this application in its entirety.

CsHCS1 has the sequence:

```
                                        (SEQ ID NO: 109)
MGKNYKSLDSVVASDFIALGITSEVAETLHGRLAEIVCNYGAATPQTWIN

IANHILSPDLPFSLHQMLFYGCYKDFGPAPPAWIPDPEKVKSTNLGALLE

KRGKEFLGVKYKDPISSFSHFQEFSVRNPEVYWRTVLMDEMKISFSKDPE

CILRRDDINNPGGSEWLPGGYLNSAKNCLNVNSNKKLNDTMIVWRDEGND

DLPLNKLTLDQLRKRVWLVGYALEEMGLEKGCAIAIDMPMHVDAVVIYLA

IVLAGYVVVSIADSFSAPEISTRLRLSKAKAIFTQDHIIRGKKRIPLYSR

VVEAKSPMAIVIPCSGSNIGAELRDGDISWDYFLERAKEFKNCEFTAREQ

PVDAYTNILFSSGTTGEPKAIPWTQATPLKAAADGWSHLDIRKGDVIVWP

TNLGWMMGPWLVYASLLNGASIALYNGSPLVSGFAKFVQDAKVTMLGVVP

SIVRSWKSTNCVSGYDWSTIRCFSSSGEASNVDEYLWLMGRANYKPVIEM

CGGTEIGGAFSAGSFLQAQSLSSFSSQCMGCTLYILDKNGYPMPKNKPGI

GELALGPVMFGASKTLLNGNHHDVYFKGMPTLNGEVLRRHGDIFELTSNG

YYHAHGRADDTMNIGGIKISSIEIERVCNEVDDRVFETTAIGVPPLGGGP

EQLVIFFVLKDSNDTTIDLNQLRLSFNLGLQKKLNPLFKVTRVVPLSSLP

RTATNKIMRRVLRQFSHFE.
```

CsHCS2 has the sequence:

```
                                        (SEQ ID NO: 129)
MEKSGYGRDGIYRSLRPPLHLPNNNNLSMVSFLFRNSSSYPQKPALIDSE

TNQILSFSHFKSTVIKVSHGFLNLGIKKNDVVLIYAPNSIHFPVCFLGII

ASGAIATTSNPLYTVSELSKQVKDSNPKLIITVPQLLEKVKGFNLPTILI

GPDSEQESSSDKVMTFNDLVNLGGSSGSEFPIVDDFKQSDTAALLYSSGT

TGMSKGVVLTHKNFIASSLMVTMEQDLVGEMDNVFLCFLPMFHVFGLAII
```

-continued

```
TYAQLQRGNTVISMARFDLEKMLKDVEKYKVTHLWVVPPVILALSKNSMV

KKFNLSSIKYIGSGAAPLGKDLMEECSKVVPYGIVAQGYGMTETCGIVSM

EDIRGGKRNSGSAGMLASGVEAQIVSVDTLKPLPPNQLGEIWVKGPNMMQ

GYFNNPQATKLTIDKKGWVHTGDLGYFDEDGHLYVVDRIKELIKYKGFQV

APAELEGLLVSHPEILDAVVIPFPDAEAGEVPVAYVVRSPNSSLTENDVK

KFIAGQVASFKRLRKVTFINSVPKSASGKILRRELIQKVRSNM.
```

In some embodiments, an AAE comprises a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or is 100% identical, including all values in between, to a sequence (e.g., nucleic acid or amino acid sequence) set forth in SEQ ID NOs:63-69, 141-142, or 707-708.

In some embodiments, an AAE acts on multiple substrates, while in other embodiments, it exhibits substrate specificity. For example, in some embodiments, an AAE exhibits substrate specificity for one or more of hexanoic acid, butyric acid, isovaleric acid, octanoic acid, or decanoic acid. In other embodiments, an AAE exhibits activity on at least two of hexanoic acid, butyric acid, isovaleric acid, octanoic acid, and decanoic acid. AAE enzymes were identified herein that exhibited activity on butyrate and/or hexanoate (FIGS. 5 and 6). Activity on butyrate was unexpected in view of disclosure in Carvalho et al. "Designing Microorganisms for Heterologous Biosynthesis of Cannabinoids" (2017) FEMS Yeast Research June 1; 17(4).

In some embodiments, an AAE described herein comprises: N at a residue corresponding to position 90 in UniProtKB-Q6C577 (SEQ ID NO:64); A at a residue corresponding to position 100 in UniProtKB-Q6C577 (SEQ ID NO:64); G at a residue corresponding to position 105 in UniProtKB-Q6C577 (SEQ ID NO:64); E at a residue corresponding to position 162 in UniProtKB-Q6C577 (SEQ ID NO:64); Y at a residue corresponding to position 195 in UniProtKB-Q6C577 (SEQ ID NO:64); G at a residue corresponding to position 205 in UniProtKB-Q6C577 (SEQ ID NO:64); K at a residue corresponding to position 208 in UniProtKB-Q6C577 (SEQ ID NO:64); P at a residue corresponding to position 243 in UniProtKB-Q6C577 (SEQ ID NO:64); H at a residue corresponding to position 246 in UniProtKB-Q6C577 (SEQ ID NO:64); G at a residue corresponding to position 261 in UniProtKB-Q6C577 (SEQ ID NO:64); F at a residue corresponding to position 270 in UniProtKB-Q6C577 (SEQ ID NO:64); V at a residue corresponding to position 284 in UniProtKB-Q6C577 (SEQ ID NO:64); L at a residue corresponding to position 289 in UniProtKB-Q6C577 (SEQ ID NO:64); V at a residue corresponding to position 290 in UniProtKB-Q6C577 (SEQ ID NO:64); P at a residue corresponding to position 291 in UniProtKB-Q6C577 (SEQ ID NO:64); P at a residue corresponding to position 301 in UniProtKB-Q6C577 (SEQ ID NO:64); A at a residue corresponding to position 321 in UniProtKB-Q6C577 (SEQ ID NO:64); V at a residue corresponding to position 328 in UniProtKB-Q6C577 (SEQ ID NO:64); Y at a residue corresponding to position 356 in UniProtKB-Q6C577 (SEQ ID NO:64); G at a residue corresponding to position 381 in UniProtKB-Q6C577 (SEQ ID NO:64); I at a residue corresponding to position 391 in UniProtKB-Q6C577 (SEQ ID NO:64); P at a residue corresponding to position 400 in UniProtKB-Q6C577 (SEQ ID NO:64); G at a residue corresponding to position 423 in UniProtKB-Q6C577 (SEQ ID NO:64); Y at a residue corresponding to position 436 in UniProtKB-Q6C577 (SEQ ID NO:64); P at a residue corresponding to position 440 in UniProtKB-Q6C577 (SEQ ID NO:64); W at a residue corresponding to position 464 in UniProtKB-Q6C577 (SEQ ID NO:64); G at a residue corresponding to position 468 in UniProtKB-Q6C577 (SEQ ID NO:64); D at a residue corresponding to position 469 in UniProtKB-Q6C577 (SEQ ID NO:64); D at a residue corresponding to position 474 in UniProtKB-Q6C577 (SEQ ID NO:64); G at a residue corresponding to position 477 in UniProtKB-Q6C577 (SEQ ID NO:64); D at a residue corresponding to position 483 in UniProtKB-Q6C577 (SEQ ID NO:64); R at a residue corresponding to position 484 in UniProtKB-Q6C577 (SEQ ID NO:64); I at a residue corresponding to position 489 in UniProtKB-Q6C577 (SEQ ID NO:64); S at a residue corresponding to position 491 in UniProtKB-Q6C577 (SEQ ID NO:64); E at a residue corresponding to position 500 in UniProtKB-Q6C577 (SEQ ID NO:64); E at a residue corresponding to position 502 in UniProtKB-Q6C577 (SEQ ID NO:64); H at a residue corresponding to position 508 in UniProtKB-Q6C577 (SEQ ID NO:64); V at a residue corresponding to position 511 in UniProtKB-Q6C577 (SEQ ID NO:64); A at a residue corresponding to position 515 in UniProtKB-Q6C577 (SEQ ID NO:64); V at a residue corresponding to position 516 in UniProtKB-Q6C577 (SEQ ID NO:64); G at a residue corresponding to position 518 in UniProtKB-Q6C577 (SEQ ID NO:64); A at a residue corresponding to position 531 in UniProtKB-Q6C577 (SEQ ID NO:64); K at a residue corresponding to position 557 in UniProtKB-Q6C577 (SEQ ID NO:64); P at a residue corresponding to position 570 in UniProtKB-Q6C577 (SEQ ID NO:64); G at a residue corresponding to position 575 in UniProtKB-Q6C577 (SEQ ID NO:64); K at a residue corresponding to position 576 in UniProtKB-Q6C577 (SEQ ID NO:64); R at a residue corresponding to position 580 in UniProtKB-Q6C577 (SEQ ID NO:64); and/or L at a residue corresponding to position 582 in UniProtKB-Q6C577 (SEQ ID NO:64).

In some embodiments an AAE described herein comprises one or more of: an amino acid sequence set forth as SGAAPLG (SEQ ID NO: 114); an amino acid sequence set forth as AYLGMSSGTSGG (SEQ ID NO: 115); an amino acid sequence set forth as DQPA (SEQ ID NO: 116); an amino acid sequence set forth as QVAPAELE (SEQ ID NO: 117); an amino acid sequence set forth as VVID (SEQ ID NO: 118); and/or an amino acid sequence set forth as SGKILRRLLR (SEQ ID NO: 119).

In some embodiments an AAE described herein comprises: the amino acid sequence set forth as SGAAPLG (SEQ ID NO: 114) at residues corresponding to positions 319-325 in UniProtKB-Q6C577 (SEQ ID NO:64); the amino acid sequence set forth as AYLGMSSGTSGG (SEQ ID NO: 115) at residues corresponding to positions 194-205 in UniProtKB-Q6C577 (SEQ ID NO:64); the amino acid sequence set forth as DQPA (SEQ ID NO: 116) at residues corresponding to positions 398-401 in UniProtKB-Q6C577 (SEQ ID NO:64); the amino acid sequence set forth as QVAPAELE (SEQ ID NO: 117) at residues corresponding to positions 495-502 in UniProtKB-Q6C577 (SEQ ID NO:64);

the amino acid sequence set forth as VVID (SEQ ID NO: 118) at residues corresponding to positions 564-567 in UniProtKB-Q6C577 (SEQ ID NO:64); and/or the amino acid sequence set forth as SGKILRRLLR (SEQ ID NO: 119) at residues corresponding to positions 574-583 in UniProtKB-Q6C577 (SEQ ID NO:64).

In some embodiments an AAE described herein comprises: an amino acid sequence with no more than three amino acid substitutions at residues corresponding to positions 428-440 in UniProtKB-Q6C577 (SEQ ID NO:64); or an amino acid sequence with no more than one amino acid substitution at residues corresponding to positions 482-491 in UniProtKB-Q6C577 (SEQ ID NO:64).

In some embodiments an AAE described herein comprises: I or V at a residue corresponding to position 432 in UniProtKB-Q6C577 (SEQ ID NO:64); S or D at a residue corresponding to position 434 in UniProtKB-Q6C577 (SEQ ID NO:64); K or N at a residue corresponding to position 438 in UniProtKB-Q6C577 (SEQ ID NO:64); and/or L or M at a residue corresponding to position 488 in UniProtKB-Q6C577 (SEQ ID NO:64).

In some embodiments an AAE described herein comprises: an amino acid sequence set forth as RGPQIMSGYHKNP (SEQ ID NO: 120); an amino acid sequence set forth as RGPQVMDGYHNNP (SEQ ID NO: 121); an amino acid sequence set forth as RGPQIMDGYHKNP (SEQ ID NO: 122); an amino acid sequence set forth as VDRTKELIKS (SEQ ID NO: 123); and/or an amino acid sequence set forth as VDRTKEMIKS (SEQ ID NO: 124).

A recombinant host cell that expresses a heterologous gene encoding an AAE described herein may be capable of producing at least 1% (e.g., at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 125%, at least 150%, at least 175%, at least 200%, at least 300%, at least 400%, at least 500%, at least 600%, at least 700%, at least 800%, at least 900%, or at least 1,000%) more hexanoyl-CoA and/or more butanoyl-coenzyme A relative to a control. In some embodiments, a control is a host cell that does not express a heterologous gene encoding an AAE.

Polyketide Synthases (PKS)

A host cell described in this application may comprise a PKS. As used in this application, a "PKS" refers to an enzyme that is capable of producing a polyketide. In certain embodiments, a PKS converts a compound of Formula (2) to a compound of Formula (4), (5), and/or (6). In certain embodiments, a PKS converts a compound of Formula (2) to a compound of Formula (4). In certain embodiments, a PKS converts a compound of Formula (2) to a compound of Formula (5). In certain embodiments, a PKS converts a compound of Formula (2) to a compound of Formula (4) and/or (5). In certain embodiments, a PKS converts a compound of Formula (2) to a compound of Formula (5) and/or (6).

In some embodiments, a PKS is a tetraketide synthase (TKS). In certain embodiments, a PKS is an olivetol synthase (OLS). As used in this application, an "OLS" refers to an enzyme that is capable of using a substrate of Formula (2a) to form a compound of Formula (4a), (5a) and/or (6a) as shown in FIG. 1. In some embodiments, an OLS catalyzes the formation of olivetol (Formula (5a)). In some embodiments, an olivetol synthase (OLS) catalyzes the formation of olivetol with minimal production of 3,5,7-trioxoalkanoyl-CoA and/or olivetolic acid. In some instances, an OLS that is capable of catalyzing the formation of olivetol may be useful in providing olivetol as a substrate for a prenyltransferase. As a non-limiting example, NphB can use olivetol as reactant. See, e.g., Kumano et al., Bioorg Med Chem. 2008 Sep. 1; 16(17): 8117-8126.

In certain embodiments, a PKS is a divarinic acid synthase (DVS).

A non-limiting example of an OLS is provided by UniProtKB-B1Q2B6 from *C. sativa*. In *C. sativa*, this OLS uses hexanoyl-CoA and malonyl-CoA as substrates to form 3,5,7-trioxododecanoyl-CoA. OLS (e.g., UniProtKB-B1Q2B6) in combination with olivetolic acid cyclase (OAC) produces olivetolic acid (OA) in *C. sativa*.

The amino acid sequence of UniProtKB-B1Q2B6 is:

(SEQ ID NO: 5)
MNHLRAEGPASVLAIGTANPENILLQDEFPDYYFRVTKSEHMTQLKEKFR

KICDKSMIRKRNCFLNEEHLKQNPRLVEHEMQTLDARQDMLVVEVPKLGK

DACAKAIKEWGQPKSKITHLIFTSASTTDMPGADYHCAKLLGLSPSVKRV

MMYQLGCYGGGTVLRIAKDIAENNKGARVLAVCCDIMACLFRGPSESDLE

LLVGQAIFGDGAAAVIVGAEPDESVGERPIFELVSTGQTILPNSEGTIGG

HIREAGLIFDLHKDVPMLISNNIEKCLIEAFTPIGISDWNSIFWITHPGG

KAILDKVEEKLHLKSDKFVDSRHVLSEHGNMSSSTVLFVMDELRKRSLEE

GKSTTGDGFEWGVLFGFGPGLTVERVVVRSVPIKY.

Structurally, an OLS comprises a triad of conserved residues, which have been implicated as catalytic residues. This triad of conserved residues may be referred to as a catalytic triad. See, e.g., Taura et al, FEBS Letters 583 (2009) 2061-2066. The catalytic triad of UniProtKB-B1Q2B6 (SEQ ID NO: 5) comprises C157, H297, and N330. One of ordinary skill in the art would be able to identify corresponding catalytic residues in other PKSs, including OLSs, by aligning the amino acid sequence of interest with UniProtKB-B1Q2B6. A PKS, including an OLS, may comprise the amino acid C at a residue corresponding to position 157 in SEQ ID NO: 5, the amino acid H at a residue corresponding to position 297 in SEQ ID NO: 5, and the amino acid N at a residue corresponding to residue 330 in SEQ ID NO: 5. As a non-limiting example, the residues corresponding to positions 157, 297, and 330 in SEQ ID NO: 5 are C164, H304, and N337, respectively in SEQ ID NO: 6. Similarly, the residues corresponding to positions 157, 297, and 330 in SEQ ID NO: 5 are C164, H304, and N337, respectively, in SEQ ID NO: 7.

The active site of a PKS may be defined by generating the three-dimensional structure of the PKS and identifying the residues within a particular distance of any of the residues within the catalytic triad and/or within a particular distance of a docked substrate within the PKS (e.g., a compound of Formula (2)). A substrate docks or binds in the substrate binding pocket of a PKS. The substrate binding pocket may comprise the active site of the PKS. As a non-limiting example, the structure of a PKS may be generated using ROSETTA software. See, e.g., Kaufmann et al., Biochemistry 2010, 49, 2987-2998.

As used herein, a residue is within the active site of an OLS enzyme if it is within about 12 angstroms of any of the residues within the catalytic triad of the OLS enzyme and/or within about 12 angstroms of a docked substrate within the OLS enzyme.

In some embodiments, a residue is within 12 angstroms (Å), within 11 Å, within 10 Å, within 9 Å, within 8 Å, within 7 Å, within 6 Å, within 5 Å, within 4 Å, within 3 Å, within 2 Å, or within 1 Å from any of the residues within the catalytic triad (i.e., 157, 297, and 330 in SEQ ID NO: 5) and/or from a docked substrate (e.g, hexanoyl-CoA).

In some embodiments, a residue in a PKS is within 20 Å, within 19 Å, within 18 Å, within 17 Å, within 16 Å, within 15 Å, within 14 Å, within 13 Å, within 12 Å, within 11 Å, within 10 Å, within 9 Å, within 8 Å, within 7 Å, within 6 Å, within 5 Å, within 4 Å, within 3 Å, within 2 Å, and/or within 1 Å from any of the residues within the catalytic triad (i.e., residues in the PKS corresponding to positions 157, 297, and 330 in SEQ ID NO: 5) and/or a docked substrate.

As a non-limiting example, positions 17, 23, 25, 51, 54, 64, 95, 123, 125, 153, 196, 201, 207, 241, 247, 267, 273, 277, 296, 307, 320, 324, 326, 328, 334, 335, and 375 in SEQ ID NO: 5 may be located within the active site of a PKS comprising SEQ ID NO: 5. Positions 51, 54, 123, 125, 201, 207, 241, 247, 267, 273, 296, 307, 324, 326, 328, 334, 335, and 375 in SEQ ID NO: 5 may be located within about 8 Å from any of the residues within the catalytic triad and/or a docked substrate of the PKS comprising SEQ ID NO: 5.

In some embodiments, a PKS comprises an amino acid substitution, insertion, or deletion at a residue that is within the active site of the PKS. In some embodiments, a PKS comprises an amino acid substitution, insertion, or deletion at a residue that is within 12 angstroms (Å), within 11 Å, within 10 Å, within 9 Å, within 8 Å, within 7 Å, within 6 Å, within 5 Å, within 4 Å, within 3 Å, within 2 Å, or within 1 Å away from any one of the catalytic triad residues (i.e., positions 157, 297, and 330 in SEQ ID NO: 5) and/or from a docked substrate. In some embodiments, the amino acid substitution, insertion, or deletion is at a residue corresponding to position 17, 23, 25, 51, 54, 64, 95, 123, 125, 153, 196, 201, 207, 241, 247, 267, 273, 277, 296, 307, 320, 324, 326, 328, 334, 335, and/or 375 in SEQ ID NO: 5. In some embodiments, a residue in a PKS corresponding to position 17, 23, 25, 51, 54, 64, 95, 123, 125, 153, 196, 201, 207, 241, 247, 267, 273, 277, 296, 307, 320, 324, 326, 328, 334, 335, and/or 375 in SEQ ID NO: 5 is located within 12 Å from the active site of the PKS. In some embodiments, a residue in a PKS corresponding to position 51, 54, 123, 125, 201, 207, 241, 247, 267, 273, 296, 307, 324, 326, 328, 334, 335, and/or 375 in SEQ ID NO: 5 is located within 8 Å from the active site of the PKS. In some embodiments, the PKS comprises one or more of: T17K, I23C, L25R, K51R, D54R, F64Y, V95 Å, T123C, A125S, Y153E, E196K, L201C, I207L, L241I, T247A, M267K, M267G, I273V, L277M, T296A, V307I, D320A, V324I, S326R, H328Y, S334P, S334A, T335C, and/or R375T relative to SEQ ID NO: 5. In some embodiments, a host cell comprising one or more of these amino acid substitutions relative to SEQ ID NO: 5 is capable of producing at least 2, 3, 4, 5, 6, 7, 8, 9, 10, 11, 12, 13, 14, 15 or more than 15 mg/L Olivetol, including all values in between.

In some embodiments, a PKS comprises: an amino acid substitution, insertion, or deletion at a residue that is more than 12 angstroms (Å), more than 11 Å, more than 10 Å, more than 9 Å, more than 8 Å, more than 7 Å, more than 6 Å, more than 5 Å, more than 4 Å, more than 3 Å, more than 2 Å, or more than 1 Å away from the catalytic triad (i.e., 157, 297, and 330 in SEQ ID NO: 5) and/or from a docked substrate. In some embodiments, the residue corresponds to position 71, 92, 100, 108, 116, 128, 135, 229, 278, 284, and/or 348 in SEQ ID NO: 5. In some embodiments, the residue in a PKS corresponding to position 71, 92, 100, 108, 116, 128, 135, 229, 278, 284, and/or 348 in SEQ ID NO: 5 is more than 12 Å from the active site of the PKS. In some embodiments, the PKS comprises one or more of: I284Y, K100L, K116R, I278E, K108D, L348S, K71R, V92G, T128V, K100M, Y135V, P229A, T128A, and/or T128I. In some embodiments, a host cell comprising one or more of these mutations is capable of producing at least 2, 3, 4, 5, 6, 7, 8, 9, 10, 11, 12, 13, 14, 15 or more than 15 mg/L Olivetol, including all values in between.

In some embodiments, a PKS comprises the amino acid C at a residue corresponding to position 335 of SEQ ID NO: 5. In some embodiments, a PKS comprises the amino acid substitution T335C relative to a control. In some embodiments, the control is a PKS comprising SEQ ID NO: 5. In some embodiments, a PKS comprises a sequence at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or is 100% identical, including all values in between, to a sequence (e.g., amino acid or nucleic sequence) set forth in SEQ ID NOs: 38, 172, 175, 176, 196, 204, 205, 7, 17, 145, 13, 8, and 15. In some embodiments, a PKS comprises a sequence at most 5%, at most 10%, at most 15%, at most 20%, at most 25%, at most 30%, at most 35%, at most 40%, at most 45%, at most 50%, at most 55%, at most 60%, at most 65%, at most 70%, at most 71%, at most 72%, at most 73%, at most 74%, at most 75%, at most 76%, at most 77%, at most 78%, at most 79%, at most 80%, at most 81%, at most 82%, at most 83%, at most 84%, at most 85%, at most 86%, at most 87%, at most 88%, at most 89%, at most 90%, at most 91%, at most 92%, at most 93%, at most 94%, at most 95%, at most 96%, at most 97%, at most 98%, at most 99%, or is 100% identical, including all values in between, to a sequence (e.g., amino acid or nucleic sequence) set forth in SEQ ID NOs: 38, 172, 175, 176, 196, 204, 205, 7, 17, 145, 13, 8, and 15.

In some embodiments, a PKS described herein comprises a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or is 100% identical, including all values in between, to a sequence (e.g., nucleic acid or amino acid sequence) set forth in UniProtKB-A0A088G5Z5 (SEQ ID NO: 7), SEQ ID NO: 714, SEQ ID NO: 715, or SEQ ID NO: 38.

In some embodiments, relative to the sequence of SEQ ID NO: 7, the PKS comprises an amino acid substitution at a residue corresponding to position 28, 34, 50, 70, 71, 76, 88, 100, 151, 203, 219, 285, 359, and/or 385 in SEQ ID NO: 7. In some embodiments, the PKS comprises: the amino acid P at a residue corresponding to position 28 in SEQ ID NO: 7; the amino acid Q at a residue corresponding to position 34 in SEQ ID NO: 7; the amino acid N at a residue corresponding to position 50 in SEQ ID NO: 7; the amino acid M at a residue corresponding to position 70 in SEQ ID NO: 7; the amino acid Y at a residue corresponding to position 71 in SEQ ID NO: 7; the amino acid I at a residue corresponding to position 76 in SEQ ID NO: 7; the amino acid A at a residue corresponding to position 88 in SEQ ID NO: 7; the amino acid P or T at a residue corresponding to position 100 in SEQ ID NO: 7; the amino acid P at a residue corresponding to position 151 in SEQ ID NO: 7; the amino acid K at a residue corresponding to position 203 in SEQ ID NO: 7; the amino acid C at a residue corresponding to position 219 in SEQ ID NO: 7; the amino acid A at a residue corresponding to position 285 in SEQ ID NO: 7; the amino acid M at a residue corresponding to position 359 in SEQ ID NO: 7; and/or the amino acid M at a residue corresponding to position 385 in SEQ ID NO: 7. In some embodiments, the PKS comprises one or more of the following amino acid substitutions relative to SEQ ID NO: 7: E28P, S34Q, V50N, F70M, V71Y, L76I, D88A, R100P, R100T, N151P, E203K, A219C, E285A, K359M, and/or L385M. In some embodiments, the PKS comprises V71Y and/or F70M. In some embodiments, the PKS comprises C at a residue corresponding to position 164 in SEQ ID NO: 7; H at a residue corresponding to position 304 in SEQ ID NO: 7; and/or N at a residue corresponding to position 337 in SEQ ID NO: 7.

In some embodiments, a host cell with a PKS that comprises an amino acid substitution at a residue corresponding to position 28, 34, 50, 70, 71, 76, 88, 100, 151, 203, 219, 285, 359, and/or 385 in SEQ ID NO: 7 produces at least 1% (e.g., at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 125%, at least 150%, at least 175%, at least 200%, at least 300%, at least 400%, at least 500%, at least 600%, at least 700%, at least 800%, at least 900%, or at least 1,000%) more of a product (e.g., a compound of Formula (4), (5), and/or (6)) relative to a host cell comprising SEQ ID NO: 7.

In some embodiments, a PKS described herein comprises: A at a residue corresponding to position 17 in UniProtKB-A0A1R3HSU5 (SEQ ID NO:6); A at a residue corresponding to position 21 in UniProtKB-A0A1R3HSU5 (SEQ ID NO:6); I at a residue corresponding to position 22 in UniProtKB-A0A1R3HSU5 (SEQ ID NO:6); G at a residue corresponding to position 23 in UniProtKB-A0A1R3HSU5 (SEQ ID NO:6); Q at a residue corresponding to position 33 in UniProtKB-A0A1R3HSU5 (SEQ ID NO:6); D at a residue corresponding to position 38 in UniProtKB-A0A1R3HSU5 (SEQ ID NO:6); F at a residue corresponding to position 41 in UniProtKB-A0A1R3HSU5 (SEQ ID NO:6); L at a residue corresponding to position 52 in UniProtKB-A0A1R3HSU5 (SEQ ID NO:6); K at a residue corresponding to position 55 in UniProtKB-A0A1R3HSU5 (SEQ ID NO:6); C at a residue corresponding to position 60 in UniProtKB-A0A1R3HSU5 (SEQ ID NO:6); R at a residue corresponding to position 68 in UniProtKB-A0A1R3HSU5 (SEQ ID NO:6); R at a residue corresponding to position 94 in UniProtKB-A0A1R3HSU5 (SEQ ID NO:6); A at a residue corresponding to position 109 in UniProtKB-A0A1R3HSU5 (SEQ ID NO:6); A at a residue corresponding to position 113 in UniProtKB-A0A1R3HSU5 (SEQ ID NO:6); W at a residue corresponding to position 117 in UniProtKB-A0A1R3HSU5 (SEQ ID NO:6); G at a residue corresponding to position 118 in UniProtKB-A0A1R3HSU5 (SEQ ID NO:6); S at a residue corresponding to position 122 in UniProtKB-A0A1R3HSU5 (SEQ ID NO:6); I at a residue corresponding to position 124 in UniProtKB-A0A1R3HSU5 (SEQ ID NO:6); T at a residue corresponding to position 125 in UniProtKB-A0A1R3HSU5 (SEQ ID NO:6); H at a residue corresponding to position 126 in UniProtKB-A0A1R3HSU5 (SEQ ID NO:6); P at a residue corresponding to position 138 in UniProtKB-A0A1R3HSU5 (SEQ ID NO:6); D at a residue corresponding to position 141 in UniProtKB-A0A1R3HSU5 (SEQ ID NO:6); L at a residue corresponding to position 150 in UniProtKB-A0A1R3HSU5 (SEQ ID NO:6); G at a residue corresponding to position 163 in UniProtKB-A0A1R3HSU5 (SEQ ID NO:6); C at a residue corresponding to position 164 in UniProtKB-A0A1R3HSU5 (SEQ ID NO:6); G at a residue corresponding to position 168 in UniProtKB-A0A1R3HSU5 (SEQ ID NO:6); R at a residue corresponding to position 172 in UniProtKB-A0A1R3HSU5 (SEQ ID NO:6); K at a residue corresponding to position 175 in UniProtKB-A0A1R3HSU5 (SEQ ID NO:6); E at a residue corresponding to position 179 in UniProtKB-A0A1R3HSU5 (SEQ ID NO:6); R at a residue corresponding to position 185 in UniProtKB-A0A1R3HSU5 (SEQ ID NO:6); L at a residue corresponding to position 187 in UniProtKB-A0A1R3HSU5 (SEQ ID NO:6); V at a residue corresponding to position 189 in UniProtKB-A0A1R3HSU5 (SEQ ID NO:6); C at a residue corresponding to position 190 in UniProtKB-A0A1R3HSU5 (SEQ ID NO:6); P at a residue corresponding to position 201 in UniProtKB-A0A1R3HSU5 (SEQ ID NO:6); F at a residue corresponding to position 215 in UniProtKB-A0A1R3HSU5 (SEQ ID NO:6); D at a residue corresponding to position 217 in UniProtKB-A0A1R3HSU5 (SEQ ID NO:6); G at a residue corresponding to position 218 in UniProtKB-A0A1R3HSU5 (SEQ ID NO:6); G at a residue corresponding to position 225 in UniProtKB-A0A1R3HSU5 (SEQ ID NO:6); E at a residue corresponding to position 234 in UniProtKB-A0A1R3HSU5 (SEQ ID NO:6); G at a residue corresponding to position 263 in UniProtKB-A0A1R3HSU5 (SEQ ID NO:6); P at a residue corresponding to position 273 in UniProtKB-A0A1R3HSU5 (SEQ ID NO:6); F at a residue corresponding to position 288 in UniProtKB-A0A1R3HSU5 (SEQ ID NO:6); D at a residue corresponding to position 295 in UniProtKB-A0A1R3HSU5 (SEQ ID NO:6); N at a residue corresponding to position 297 in UniProtKB-A0A1R3HSU5 (SEQ ID NO:6); F at a residue corresponding to position 300 in UniProtKB-A0A1R3HSU5 (SEQ ID NO:6); H at a residue corresponding to position 304 in UniProtKB-A0A1R3HSU5 (SEQ ID NO:6); G at a residue corresponding to position 306 in UniProtKB-A0A1R3HSU5 (SEQ ID NO:6); G at a residue corresponding to position 307 in UniProtKB-A0A1R3HSU5 (SEQ ID NO:6); L at a residue corresponding to position 311 in UniProtKB-A0A1R3HSU5 (SEQ ID NO:6); G at a residue corresponding to position 336 in UniProtKB-A0A1R3HSU5 (SEQ ID NO:6); N at a residue corresponding to position 337 in UniProtKB-A0A1R3HSU5 (SEQ ID NO:6); M at a residue corresponding to position 338 in UniProtKB-A0A1R3HSU5 (SEQ ID NO:6); V at a residue corresponding to position 343 in UniProtKB-A0A1R3HSU5 (SEQ ID NO:6); D at a residue corresponding to position 348 in UniProtKB-A0A1R3HSU5 (SEQ ID NO:6); R at a residue corresponding to position 351 in UniProtKB-A0A1R3HSU5 (SEQ ID NO:6); G at a residue corresponding to position 363 in UniProtKB-A0A1R3HSU5 (SEQ ID NO:6); G at a residue corresponding to position 365 in UniProtKB-A0A1R3HSU5 (SEQ ID NO:6); G at a residue corresponding to position 369 in UniProtKB-A0A1R3HSU5 (SEQ ID NO:6); G at a residue corresponding to position 375 in UniProtKB-A0A1R3HSU5 (SEQ ID NO:6); P at a residue corresponding to position 376 in UniProtKB-A0A1R3HSU5 (SEQ ID NO:6); G at a residue corresponding to position 377 in UniProtKB-A0A1R3HSU5 (SEQ ID NO:6); E at a residue corresponding to position 381 in UniProtKB-A0A1R3HSU5 (SEQ ID NO:6); and/or S at a residue corresponding to position 387 in UniProtKB-A0A1R3HSU5 (SEQ ID NO:6).

In some embodiments, a PKS described herein comprises: S, T, or G at a residue corresponding to position 18 in UniProtKB-A0A1R3HSU5 (SEQ ID NO:6); V or I at a residue corresponding to position 19 in UniProtKB-A0A1R3HSU5 (SEQ ID NO:6); E, P, S, A, or D at a residue corresponding to position 28 in UniProtKB-A0A1R3HSU5 (SEQ ID NO:6); I, C, I, S, F, Y, Q, H, A, or V at a residue corresponding to position 30 in UniProtKB-A0A1R3HSU5 (SEQ ID NO:6); D, S, C, I, A, or D at a residue corresponding to position 34 in UniProtKB-A0A1R3HSU5 (SEQ ID NO:6); F or Y at a residue corresponding to position 36 in UniProtKB-A0A1R3HSU5 (SEQ ID NO:6); Y, F, or V at a residue corresponding to position 39 in UniProtKB-A0A1R3HSU5 (SEQ ID NO:6); K, N, D, or S at a residue corresponding to position 45 in UniProtKB-A0A1R3HSU5 (SEQ ID NO:6); K, R, or H at a residue corresponding to position 58 in UniProtKB-A0A1R3HSU5 (SEQ ID NO:6); F, H, V, Y, or N at a residue corresponding to position 71 in UniProtKB-A0A1R3HSU5 (SEQ ID NO:6); R, N, C, E, S, or H at a residue corresponding to position 82 in UniProtKB-A0A1R3HSU5 (SEQ ID NO:6); M, A, D, S, E, or V at a residue corresponding to position 88 in UniProtKB-A0A1R3HSU5 (SEQ ID NO:6); Q, P, S, N, L, or K at a residue corresponding to position 89 in UniProtKB-A0A1R3HSU5 (SEQ ID NO:6); T or S at a residue corresponding to position 90 in UniProtKB-A0A1R3HSU5 (SEQ ID NO:6); M, I, F, L, or V at a residue corresponding to position 97 in UniProtKB-A0A1R3HSU5 (SEQ ID NO:6); D, E, K, or A at a residue corresponding to position 108 in UniProtKB-A0A1R3HSU5 (SEQ ID NO:6); C, A, or S at a residue corresponding to position 110 in UniProtKB-A0A1R3HSU5 (SEQ ID NO:6); T, C, or Y at a residue corresponding to position 130 in UniProtKB-A0A1R3HSU5 (SEQ ID NO:6); S or T at a residue corresponding to position 131 in UniProtKB-A0A1R3HSU5 (SEQ ID NO:6); A, S, T, or I at a residue corresponding to position 132 in UniProtKB-A0A1R3HSU5 (SEQ ID NO:6); L, Q, or H at a residue corresponding to position 162 in UniProtKB-A0A1R3HSU5 (SEQ ID NO:6); G, A, or S at a residue corresponding to position 166 in UniProtKB-A0A1R3HSU5 (SEQ ID NO:6); I, L, V, T, M, or Y at a residue corresponding to position 173 in UniProtKB-A0A1R3HSU5 (SEQ ID NO:6); I, L, F, or V at a residue corresponding to position 177 in UniProtKB-A0A1R3HSU5 (SEQ ID NO:6); C, S, or A at a residue corresponding to position 191 in UniProtKB-A0A1R3HSU5 (SEQ ID NO:6); D or E at a residue corresponding to position 192 in UniProtKB-A0A1R3HSU5 (SEQ ID NO:6); M or T at a residue corresponding to position 194 in UniProtKB-A0A1R3HSU5 (SEQ ID NO:6); L, C, T, S, M, or N at a residue corresponding to position 197 in UniProtKB-A0A1R3HSU5 (SEQ ID NO:6); E or D at a residue corresponding to position 207 in UniProtKB-A0A1R3HSU5 (SEQ ID NO:6); V, L, M, or I at a residue corresponding to position 222 in UniProtKB-A0A1R3HSU5 (SEQ ID NO:6); I, L, C, S, V, or M at a residue corresponding to position 237 in UniProtKB-A0A1R3HSU5 (SEQ ID NO:6); T, A, N, or S at a residue corresponding to position 243 in UniProtKB-A0A1R3HSU5 (SEQ ID NO:6); N, D, E, or G at a residue corresponding to position 250 in UniProtKB-A0A1R3HSU5 (SEQ ID NO:6); I or L at a residue corresponding to position 299 in UniProtKB-A0A1R3HSU5 (SEQ ID NO:6); K, P, or R at a residue corresponding to position 308 in UniProtKB-A0A1R3HSU5 (SEQ ID NO:6); F, L, or M at a residue corresponding to position 325 in UniProtKB-A0A1R3HSU5 (SEQ ID NO:6); H or Y at a residue corresponding to position 335 in UniProtKB-A0A1R3HSU5; M or L at a residue corresponding to position 347 in UniProtKB-A0A1R3HSU5 (SEQ ID NO:6); L, M, I, or T at a residue corresponding to position 350 in UniProtKB-A0A1R3HSU5 (SEQ ID NO:6); F, L, or M at a residue corresponding to position 366 in UniProtKB-A0A1R3HSU5 (SEQ ID NO:6); and/or R or T at a residue corresponding to position 382 in UniProtKB-A0A1R3HSU5 (SEQ ID NO:6).

In some embodiments, a PKS comprises a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or is 100% identical, including all values in between, to a sequence (e.g., nucleic acid or amino acid sequence) set forth in SEQ ID NOs: 1-31, 77-92, 143-171, 207-249, 293-420, 549-627, 32-62, 93-108, 172-206, 250-292, 421-548, 628-705, and 706 or to a sequence selected from Tables 5-6 and 13-16.

In some embodiments, a PKS comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, at least 112, at least 113, at least 114, at least 115, at least 116, at least 117, at least 118, at least 119, at least 120, at least 121, at least 122, at least 123, at least 124, at least 125, at least 126, at least 127, at least 128, at least 129, at least 130, at least 131, at least 132, at least 133, at least 134, at least 135, at least 136, at least 137, at least 138, at least 139, at least 140, at least 141, at least 142, at least 143, at least 144, at least 145, at least 146, at least 147, at least 148, at least 149, at least 150, at least 151, at least 152, at least 153, at least 154, at least 155, at least 156, at least 157, at least 158, at least 159, at least 160, at least 161, at least 162, at least 163, at least 164, at least 165, at least 166, at least 167, at least 168, at least 169, at least 170, at least 171, at least 172, at least 173, at least 174, at least 175, at least 176, at least 177, at least 178, at least 179, at least 180, at least 181, at least 182, at least 183, at least 184, at least 185, at least 186, at least 187, at least 188, at least 189, at least 190, at least 191, at least 192, at least 193, at least 194, at least 195, at least 196, at least 197, at least 198, at least 199, at least 200, at least 201, at least 202, at least 203, at least 204, at least 205, at least 206, at least 207, at least 208, at least 209, at least 210, at least 211, at least 212, at least 213, at least 214, at least 215, at least 216, at least 217, at least 218, at least 219, at least 220, at least 221, at least 222, at least 223, at least 224, at least 225, at least 226, at least 227, at least 228, at least 229, at least 230, at least 231, at least 232, at least 233, at least 234, at least 235, at least 236, at least 237, at least 238, at least 239, at least 240, at least 241, at least 242, at least 243, at least 244, at least 245, at least 246, at least 247, at least 248, at least 249, at least 250, at least 251, at least 252, at least 253, at least 254, at least 255, at least 256, at least 257, at least 258, at least 259, at least 260, at least 261, at least 262, at least 263, at least 264, at least 265, at least 266, at least 267, at least 268, at least 269, at least 270, at least 271, at least 272, at least 273, at least 274, at least 275, at least 276, at least 277, at least 278, at least 279, at least 280, at least 281, at least 282, at least 283, at least 284, at least 285, at least 286, at least 287, at least 288, at least 289, at least 290, at least 291, at least 292, at least 293, at least 294, at least 295, at least 296, at least 297, at least 298, at least 299, at least 300, at least 301, at least 302, at least 303, at least 304, at least 305, at least 306, at least 307, at least 308, at least 309, at least 310, at least 311, at least 312, at least 313, at least 314, at least 315, at least 316, at least 317, at least 318, at least 319, at least 320, at least 321, at least 322, at least 323, at least 324, at least 325, at least 326, at least 327, at least 328, at least 329, at least 330, at least 331, at least 332, at least 333, at least 334, at least 335, at least 336, at least 337, at least 338, at least 339, at least 340, at least 341, at least 342, at least 343, at least 344, at least 345, at least 346, at least 347, at least 348, at least 349, at least 350, at least 351, at least 352, at least 353, at least 354, at least 355, at least 356, at least 357, at least 358, at least 359, at least 360, at least 361, at least 362, at least 363, at least 364, at least 365, at least 366, at least 367, at least 368, at least 369, at least 370, at least 371, at least 372, at least 373, at least 374, at least 375, at least 376, at least 377, at least 378, at least 379, or at least 380 amino acid substitutions, deletions, or insertions relative to SEQ ID NOs: 1-31, 77-92, 143-171, 207-249, 293-420, and 549-627 or to an amino acid sequence selected from Tables 5-6 and 13-16.

In some embodiments, a PKS comprises at most 1, at most 2, at most 3, at most 4, at most 5, at most 6, at most 7, at most 8, at most 9, at most 10, at most 11, at most 12, at most 13, at most 14, at most 15, at most 16, at most 17, at most 18, at most 19, at most 20, at most 21, at most 22, at most 23, at most 24, at most 25, at most 26, at most 27, at most 28, at most 29, at most 30, at most 31, at most 32, at most 33, at most 34, at most 35, at most 36, at most 37, at most 38, at most 39, at most 40, at most 41, at most 42, at most 43, at most 44, at most 45, at most 46, at most 47, at most 48, at most 49, at most 50, at most 51, at most 52, at most 53, at most 54, at most 55, at most 56, at most 57, at most 58, at most 59, at most 60, at most 61, at most 62, at most 63, at most 64, at most 65, at most 66, at most 67, at most 68, at most 69, at most 70, at most 71, at most 72, at most 73, at most 74, at most 75, at most 76, at most 77, at most 78, at most 79, at most 80, at most 81, at most 82, at most 83, at most 84, at most 85, at most 86, at most 87, at most 88, at most 89, at most 90, at most 91, at most 92, at most 93, at most 94, at most 95, at most 96, at most 97, at most 98, at most 99, at most 100, at most 101, at most 102, at most 103, at most 104, at most 105, at most 106, at most 107, at most 108, at most 109, at most 110, at most 111, at most 112, at most 113, at most 114, at most 115, at most 116, at most 117, at most 118, at most 119, at most 120, at most 121, at most 122, at most 123, at most 124, at most 125, at most 126, at most 127, at most 128, at most 129, at most 130, at most 131, at most 132, at most 133, at most 134, at most 135, at most 136, at most 137, at most 138, at most 139, at most 140, at most 141, at most 142, at most 143, at most 144, at most 145, at most 146, at most 147, at most 148, at most 149, at most 150, at most 151, at most 152, at most 153, at most 154, at most 155, at most 156, at most 157, at most 158, at most 159, at most 160, at most 161, at most 162, at most 163, at most 164, at most 165, at most 166, at most 167, at most 168, at most 169, at most 170, at most 171, at most 172, at most 173, at most 174, at most 175, at most 176, at most 177, at most 178, at most 179, at most 180, at most 181, at most 182, at most 183, at most 184, at most 185, at most 186, at most 187, at most 188, at most 189, at most 190, at most 191, at most 192, at most 193, at most 194, at most 195, at most 196, at most 197, at most 198, at most 199, at most 200, at most 201, at most 202, at most 203, at most 204, at most 205, at most 206, at most 207, at most 208, at most 209, at most 210, at most 211, at most 212, at most 213, at most 214, at most 215, at most 216, at most 217, at most 218, at most 219, at most 220, at most 221, at most 222, at most 223, at most 224, at most 225, at most 226, at most 227, at most 228, at most 229, at most 230, at most 231, at most 232, at most 233, at most 234, at most 235, at most 236, at most 237, at most 238, at most 239, at most 240, at most 241, at most 242, at most 243, at most 244, at most 245, at most 246, at most 247, at most 248, at most 249, at most 250, at most 251, at most 252, at most 253, at most 254, at most 255, at most 256, at most 257, at most 258, at most 259, at most 260, at most 261, at most 262, at most 263, at most 264, at most 265, at most 266, at most 267, at most 268, at most 269, at most 270, at most 271, at most 272, at most 273, at most 274, at most 275, at most 276, at most 277, at most 278, at most 279, at most 280, at most 281, at most 282, at most 283, at most 284, at most 285, at most 286, at most 287, at most 288, at most 289, at most 290, at most 291, at most 292, at most 293, at most 294, at most 295, at most 296, at most 297, at most 298, at most 299, at most 300, at most 301, at most 302, at most 303, at most 304, at most 305, at most 306, at most 307, at most 308, at most 309, at most 310, at most 311, at most 312, at most 313, at most 314, at most 315, at most 316, at most 317, at most 318, at most 319, at most 320, at most 321, at most 322, at most 323, at most 324, at most 325, at most 326, at most 327, at most 328, at most 329, at most 330, at most 331, at most 332, at most 333, at most 334, at most 335, at most 336, at most 337, at most 338, at most 339, at most 340, at most 341, at most 342, at most 343, at most 344, at most 345, at most 346, at most 347, at most 348, at most 349, at most 350, at most 351, at most 352, at most 353, at most 354, at most 355, at most 356, at most 357, at most 358, at most 359, at most 360, at most 361, at most 362, at most 363, at most 364, at most 365, at most 366, at most 367, at most 368, at most 369, at most 370, at most 371, at most 372, at most 373, at most 374, at most 375, at most 376, at most 377, at most 378, at most 379, or at most 380 amino acid substitutions, deletions, or insertions relative to 1-31, 77-92, 143-171, 207-249, 293-420, and 549-627 or to an amino acid sequence selected from Tables 5-6 and 13-16.

As one of ordinary skill in the art would appreciate a PKS, such as an OLS, could be obtained from any source, including naturally occurring sources and synthetic sources (e.g., a non-naturally occurring PKS). In some embodiments a PKS is from *Cannabis*. In some embodiments a PKS is from

*Dictyostelium*. Non-limiting examples of PKS enzymes may be found in U.S. Pat. No. 6,265,633; WO2019/202510; WO 2018/148848 A1; WO 2018/148849 A1; and US 2018/155748 (granted as U.S. Pat. No. 10,435,727), which are incorporated by reference in this application in their entireties. For example, PKSs include SEQ ID NO: 2 from WO2019/202510, SEQ ID NO: 9 from WO2019/202510, SEQ ID NO: 37 from WO 2018/148848 A1, SEQ ID NO: 38 from WO 2018/148848 A1, SEQ ID NO: 9 from WO 2018/148849 A1, SEQ ID NO: 10 from WO 2018/148849 A1, SEQ ID NO: 13 from WO 2018/148849 A1; and SEQ ID NO: 35 from U.S. Pat. No. 10,435,727.

In certain embodiments, polyketide synthases can use hexanoyl-CoA or any acyl-CoA (or a product of Formula (2)):

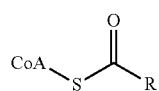
(2)

and three malonyl-CoAs as substrates to form 3,5,7-trioxododecanoyl-CoA or other 3,5,7-trioxo-acyl-CoA derivatives; or to form a compound of Formula (4):

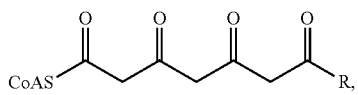
(4)

wherein R is hydrogen, optionally substituted acyl, optionally substituted alkyl, optionally substituted alkenyl, optionally substituted alkynyl, optionally substituted carbocyclyl, or optionally substituted aryl; depending on substrate. R is as defined in this application. In some embodiments, R is a C2-C6 optionally substituted alkyl. In some embodiments, R is a propyl or pentyl. In some embodiments, R is pentyl. In some embodiments, R is propyl. A PKS may also bind isovaleryl-CoA, octanoyl-CoA, hexanoyl-CoA, and butyryl-CoA. In some embodiments, a PKS is capable of catalyzing the formation of a 3,5,7-trioxoalkanoyl-CoA (e.g. 3,5,7-trioxododecanoyl-CoA). In some embodiments, an OLS is capable of catalyzing the formation of a 3,5,7-trioxoalkanoyl-CoA (e.g. 3,5,7-trioxododecanoyl-CoA).

In some embodiments, a PKS uses a substrate of Formula (2) to form a compound of Formula (4):

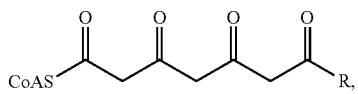
(4)

wherein R is unsubstituted pentyl.

A recombinant host cell that expresses a heterologous gene encoding an PKS described herein may be capable of producing at least 1% (e.g., at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, at least 125%, at least 150%, at least 175%, at least 200%, at least 300%, at least 400%, at least 500%, at least 600%, at least 700%, at least 800%, at least 900%, or at least 1,000%) more of a product (e.g., a compound of Formula (4), (5), and/or (6)) relative to a control. In some embodiments, a compound of Formula (4) is a compound of Formula (4a), a compound of Formula (5) is a compound of Formula (5a), and a compound of Formula (6) is a compound of Formula (6a). In some embodiments, a control is a recombinant host cell that expresses a heterologous gene encoding UniProtKB-B1Q2B6. In some embodiments, a control is a recombinant host cell that expresses a heterologous gene encoding a wild-type PKS.

A recombinant host cell that expresses a heterologous gene encoding an PKS described herein may be capable of producing at least 0.5 mg/L, at least 1 mg/L, at least 1.5 mg/L, at least 2 mg/L, at least 2.5 mg/L, at least 3 mg/L, at least 3.5 mg/L, at least 4 mg/L, at least 4.5 mg/L, at least 5 mg/L, at least 5.5 mg/L, at least 6 mg/L, at least 6.5 mg/L, at least 7 mg/L, at least 7.5 mg/L, at least 8 mg/L, at least 8.5 mg/L, at least 9 mg/L, at least 9.5 mg/L, at least 10 mg/L, at least 10.5 mg/L, at least 11 mg/L, at least 11.5 mg/L, at least 12 mg/L, at least 12.5 mg/L, at least 13 mg/L, at least 13.5 mg/L, at least 14 mg/L, at least 14.5 mg/L, at least 15 mg/L, at least 15.5 mg/L, at least 16 mg/L, at least 16.5 mg/L, at least 17 mg/L, at least 17.5 mg/L, at least 18 mg/L, at least 18.5 mg/L, at least 19 mg/L, at least 19.5 mg/L, at least 20 mg/L, at least 20.5 mg/L, at least 21 mg/L, at least 21.5 mg/L, at least 22 mg/L, at least 22.5 mg/L, at least 23 mg/L, at least 23.5 mg/L, at least 24 mg/L, at least 24.5 mg/L, at least 25 mg/L, at least 25.5 mg/L, at least 26 mg/L, at least 26.5 mg/L, at least 27 mg/L, at least 27.5 mg/L, at least 28 mg/L, at least 28.5 mg/L, at least 29 mg/L, at least 29.5 mg/L, at least 30 mg/L, at least 30.5 mg/L, at least 31 mg/L, at least 31.5 mg/L, at least 32 mg/L, at least 32.5 mg/L, at least 33 mg/L, at least 33.5 mg/L, at least 34 mg/L, at least 34.5 mg/L, at least 35 mg/L, at least 35.5 mg/L, at least 36 mg/L, at least 36.5 mg/L, at least 37 mg/L, at least 37.5 mg/L, at least 38 mg/L, at least 38.5 mg/L, at least 39 mg/L, at least 39.5 mg/L, at least 40 mg/L, at least 40.5 mg/L, at least 41 mg/L, at least 41.5 mg/L, at least 42 mg/L, at least 42.5 mg/L, at least 43 mg/L, at least 43.5 mg/L, at least 44 mg/L, at least 44.5 mg/L, at least 45 mg/L, at least 45.5 mg/L, at least 46 mg/L, at least 46.5 mg/L, at least 47 mg/L, at least 47.5 mg/L, at least 48 mg/L, at least 48.5 mg/L, at least 49 mg/L, at least 49.5 mg/L, at least 50 mg/L, at least 50.5 mg/L, at least 51 mg/L, at least 51.5 mg/L, at least 52 mg/L, at least 52.5 mg/L, at least 53 mg/L, at least 53.5 mg/L, at least 54 mg/L, at least 54.5 mg/L, at least 55 mg/L, at least 55.5 mg/L, at least 56 mg/L, at least 56.5 mg/L, at least 57 mg/L, at least 57.5 mg/L, at least 58 mg/L, at least 58.5 mg/L, at least 59 mg/L, at least 59.5 mg/L, at least 60 mg/L, at least 60.5 mg/L, at least 61 mg/L, at least 61.5 mg/L, at least 62 mg/L, at least 62.5 mg/L, at least 63 mg/L, at least 63.5 mg/L, at least 64 mg/L, at least 64.5 mg/L, at least 65 mg/L, at least 65.5 mg/L, at least 66 mg/L, at least 66.5 mg/L, at least 67 mg/L, at least 67.5 mg/L, at least 68 mg/L, at least 68.5 mg/L, at least 69 mg/L, at least 69.5 mg/L, at least 70 mg/L, at least 70.5 mg/L, at least 71 mg/L, at least 71.5 mg/L, at least 72 mg/L, at least 72.5 mg/L, at least 73 mg/L, at least 73.5 mg/L, at least 74 mg/L, at least 74.5 mg/L, at least 75 mg/L, at least 75.5 mg/L, at least 76 mg/L, at least 76.5 mg/L, at least 77 mg/L, at least 77.5 mg/L, at least 78 mg/L, at least 78.5 mg/L, at least 79 mg/L, at least 79.5 mg/L, at least 80 mg/L, at least 80.5 mg/L, at least 81 mg/L, at least 81.5 mg/L, at least 82 mg/L, at least 82.5 mg/L, at least 83 mg/L, at least 83.5 mg/L, at least 84 mg/L, at least 84.5 mg/L, at least 85 mg/L, at least 85.5 mg/L, at least 86 mg/L, at least 86.5 mg/L, at least 87 mg/L, at least 87.5 mg/L, at least 88 mg/L, at least 88.5 mg/L, at least 89 mg/L, at least 89.5 mg/L, at least 90 mg/L, at least 90.5 mg/L, at least 91 mg/L, at least 91.5 mg/L, at least 92 mg/L, at least 92.5 mg/L, at least 93 mg/L, at least 93.5 mg/L, at least 94 mg/L, at least 94.5 mg/L, at least 95 mg/L, at least 95.5 mg/L, at least 96 mg/L, at least 96.5 mg/L, at least 97 mg/L, at least 97.5 mg/L, at least 98 mg/L, at least 98.5 mg/L, at least 99 mg/L, at least 99.5 mg/L, or at least 100 mg/L of a product (e.g., a compound of Formula (4), (5), and/or (6). In some instances, OLSs may form triketide (PDAL) and/or tetraketide (HTAL and olivetol) by-products. Triketides convert to PDAL, and tetraketides convert to HTAL and olivetol, not to olivetolic acid. In some embodiments, production of by-products is undesirable. In some embodiments, OLS enzymes described herein do not produce by-products or produce minimal by-products relative to a control. In some embodiments, OLS enzymes are selected, at least in part, based on the ratio of olivetolic acid produced relative to olivetol.

It was surprisingly discovered herein that OLSs can exhibit both OLS and OAC activity. PKS enzymes described in this application may or may not have cyclase activity. In some embodiments where the PKS enzyme does not have cyclase activity, one or more exogenous polynucleotides that encode a polyketide cyclase (PKC) enzyme may also be co-expressed in the same host cells to enable conversion of hexanoic acid or butyric acid or other fatty acid conversion into olivetolic acid or divarinolic acid or other precursors of cannabinoids. In some embodiments, the PKS enzyme and a PKC enzyme are expressed as separate and distinct enzymes. In some embodiments, a PKS enzyme that lacks cyclase activity and a PKC are linked as part of a fusion polypeptide that is a bifunctional PKS. In some embodiments, a bifunctional PKC is referred to as a bifunctional PKS-PKC. In some embodiments, a bifunctional PKC is a bifunctional tetraketide synthase (TKS-TKC).

As used in this application, a bifunctional PKS is an enzyme that is capable of producing a compound of Formula (6):

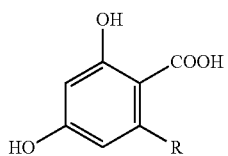

(6)

from a compound of Formula (2):

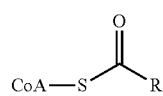

(2)

and a compound of Formula (3):

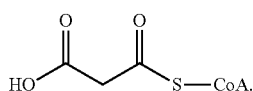

(3)

In some embodiments, a PKS produces more of a compound of Formula (6):

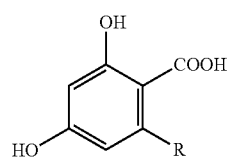

(6)

as compared to a compound of Formula (5):

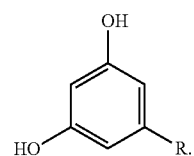

(5)

As a non-limiting example, a compound of Formula (6):

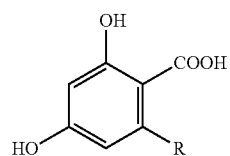

(6)

is olivetolic acid (Formula (6a)):

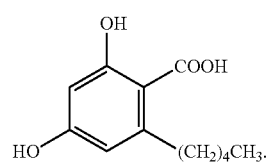

(6a)

As a non-limiting example, a compound of Formula (5):

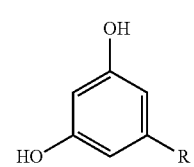

(5)

is olivetol (Formula (5a)):

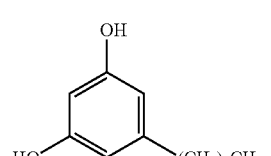

(5a)

In some embodiments, a polyketide synthase of the present disclosure is capable of catalyzing a compound of Formula (2):

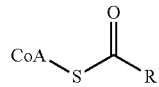
(2)

and a compound of Formula (3):

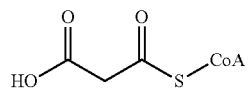
(3)

to produce a compound of Formula (4):

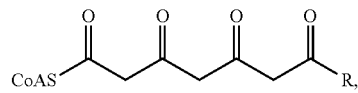
(4)

and also further catalyzes a compound of Formula (4):

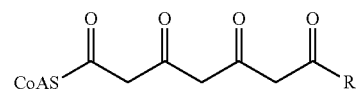
(4)

to produce a compound of Formula (6):

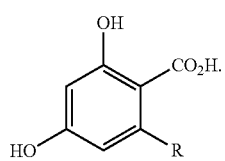
(6)

In some embodiments, the PKS is not a fusion protein. In some embodiments, a PKS that is capable of catalyzing a compound of Formula (2):

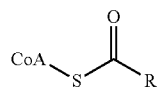
(2)

and a compound of Formula (3):

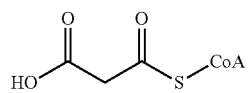
(3)

to produce a compound of Formula (4):

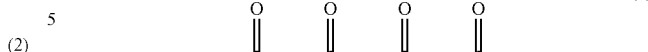
(4)

and is also capable of further catalyzing the production of a compound of Formula (6):

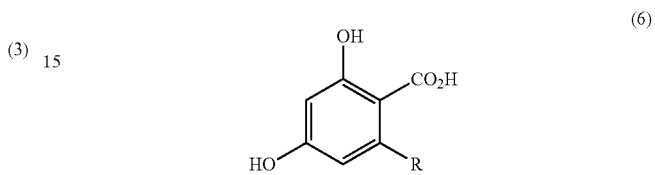
(6)

from the compound of Formula (4):

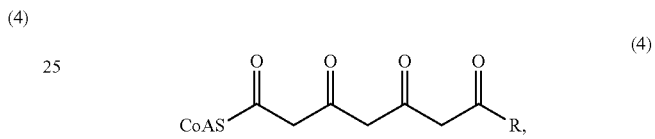
(4)

is preferred because it avoids the need for an additional polyketide cyclase to produce a compound of Formula (6):

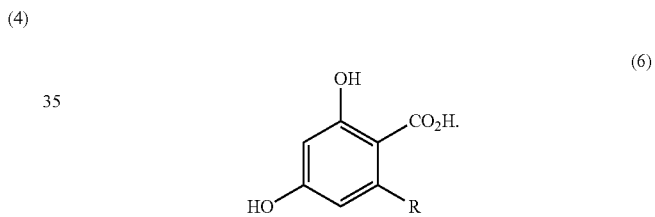
(6)

In some embodiments, such an enzyme that is a bifunctional PKS eliminates the transport considerations needed with addition of a polyketide cyclase, whereby the compound of Formula (4), being the product of the PKS, must be transported to the PKS for use as a substrate to be converted into the compound of Formula (6).

In some embodiments, a PKS is capable of producing olivetolic acid in the presence of a compound of Formula (2a):

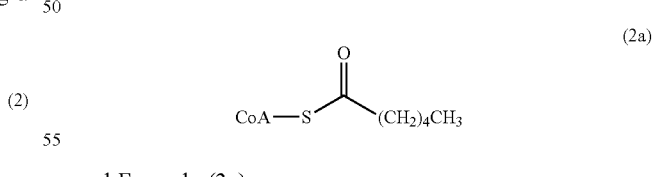
(2a)

and Formula (3a):

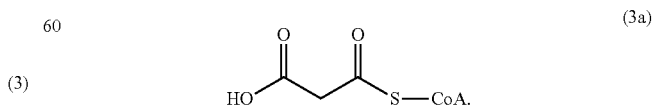
(3a)

In some embodiments, an OLS is capable of producing olivetolic acid in the presence of a compound of Formula (2a):

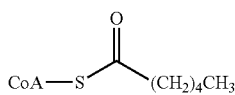

(2a)

and Formula (3a):

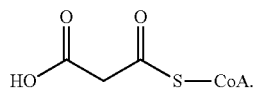

(3a)

Without being bound by a particular theory, the presence of the amino acid W at a residue in a PKS corresponding to position 339 of SEQ ID NO: 6 may render or enhance bifunctionality of a PKS. In some embodiments, a bifunctional PKS comprises the amino acid W at a residue corresponding to position 339 of SEQ ID NO: 6. In some embodiments, a bifunctional PKS does not comprise the amino acid S at a residue corresponding to position 339 of SEQ ID NO: 6. As a non-limiting example, a PKS may comprise the amino acid substitution S332W relative to SEQ ID NO: 5 (see, e.g., t606899, SEQ ID NO: 298). In some embodiments, a PKS may comprise the amino acid substitution S339W relative to SEQ ID NO: 7 (see, e.g., t607377, SEQ ID NO: 409) In some embodiments, the PKS comprises a sequence that is at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or is 100% identical, including all values in between, to a sequence (e.g., nucleic acid or amino acid sequence) set forth in SEQ ID NO: 6.

In some embodiments, an OLS is capable of producing olivetolic acid in the presence of a compound of Formula (2a) and Formula (3a). In some embodiments, the OLS produces more olivetolic acid (OA) than olivetol. In some embodiments, the OLS produces at least 1.1 times, 1.2 times, 1.3 times, 1.4 times, 1.5 times, 1.6 times, 1.7 times, 1.8 times, 1.9 times, 2 times, 2.1 times, 2.2 times, 2.3 times, 2.4 times, 2.5 times, 2.6 times, 2.7 times, 2.8 times, 2.9 times, 3 times, 3.1 times, 3.2 times, 3.3 times, 3.4 times, 3.5 times, 3.6 times, 3.7 times, 3.8 times, 3.9 times, 4 times, 5 times, 6 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times or 1,000 times more olivetolic acid (OA) than olivetol.

Without wishing to be bound by any theory, in some embodiments, bifunctional OLSs differ from other OLSs in the geometry of the substrate binding pocket, an internal substrate holding cavity, and/or a substrate exit tunnel. For example, the substrate binding pocket of the bifunctional OLSs may be wider as compared to the substrate binding pocket of Cannabis saliva OLS (SEQ ID NO: 5). Without wishing to be bound by any theory, this extra space may alleviate steric clashes between the protein and substrate and permit the pro-cyclization configuration.

Polyketide Cyclase (PKC)

A host cell described in this application may comprise a PKC. As used in this application, a "PKC" refers to an enzyme that is capable of cyclizing a polyketide.

In certain embodiments, a polyketide cyclase (PKC) catalyzes the cyclization of an oxo fatty acyl-CoA (e.g., a compound of Formula (4)):

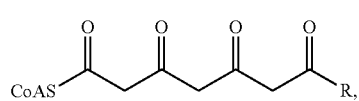

(4)

or 3,5,7-trioxododecanoyl-COA, 3,5,7-trioxodecanoyl-COA) to the corresponding intramolecular cyclization product (e.g., compound of Formula (6), including olivetolic acid and divarinic acid). In some embodiments, a PKC catalyzes the formation of a compound which occurs in the presence of a PKS. PKC substrates include trioxoalkanol-CoA, such as 3,5,7-Trioxododecanoyl-CoA, or a compound of Formula (4):

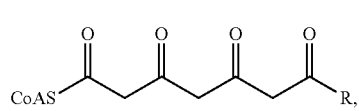

(4)

wherein R is hydrogen, optionally substituted acyl, optionally substituted alkyl, optionally substituted alkenyl, optionally substituted alkynyl, optionally substituted carbocyclyl, or optionally substituted aryl. In certain embodiments, a PKC catalyzes a compound of Formula (4):

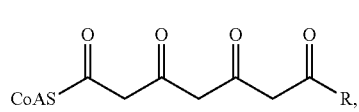

(4)

wherein R is hydrogen, optionally substituted acyl, optionally substituted alkyl, optionally substituted alkenyl, optionally substituted alkynyl, optionally substituted carbocyclyl, or optionally substituted aryl; to form a compound of Formula (6):

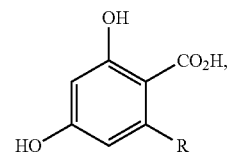

(6)

wherein R is hydrogen, optionally substituted acyl, optionally substituted alkyl, optionally substituted alkenyl, optionally substituted alkynyl, optionally substituted carbocyclyl, or optionally substituted aryl; as substrates. R is as defined in this application. In some embodiments, R is a C2-C6 optionally substituted alkyl. In some embodiments, R is a propyl or pentyl. In some embodiments, R is pentyl. In some embodiments, R is propyl. In certain embodiments, a PKC is an olivetolic acid cyclase (OAC). In certain embodiments, a PKC is a divarinic acid cyclase (DAC).

As one of ordinary skill in the art would appreciate a PKC could be obtained from any source, including naturally occurring sources and synthetic sources (e.g., a non-naturally occurring PKC). In some embodiments, a PKC is from *Cannabis*. Non-limiting examples of PKCs include those disclosed in U.S. Pat. Nos. 9,611,460; 10,059,971; and US Pub 2019/0169661, which are incorporated by reference in this application in their entireties.

In some embodiments, a PKC is an OAC. As used in this application, an "OAC" refers to an enzyme that is capable of catalyzing the formation of olivetolic acid (OA). In some embodiments, an OAC is an enzyme that is capable of using a substrate of Formula (4a) (3,5,7-trioxododecanoyl-CoA):

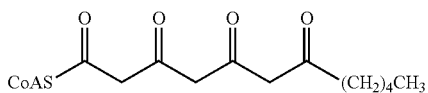

(4a)

to form a compound of Formula (6a) (olivetolic acid):

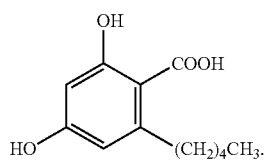

(6a)

Figure 4:
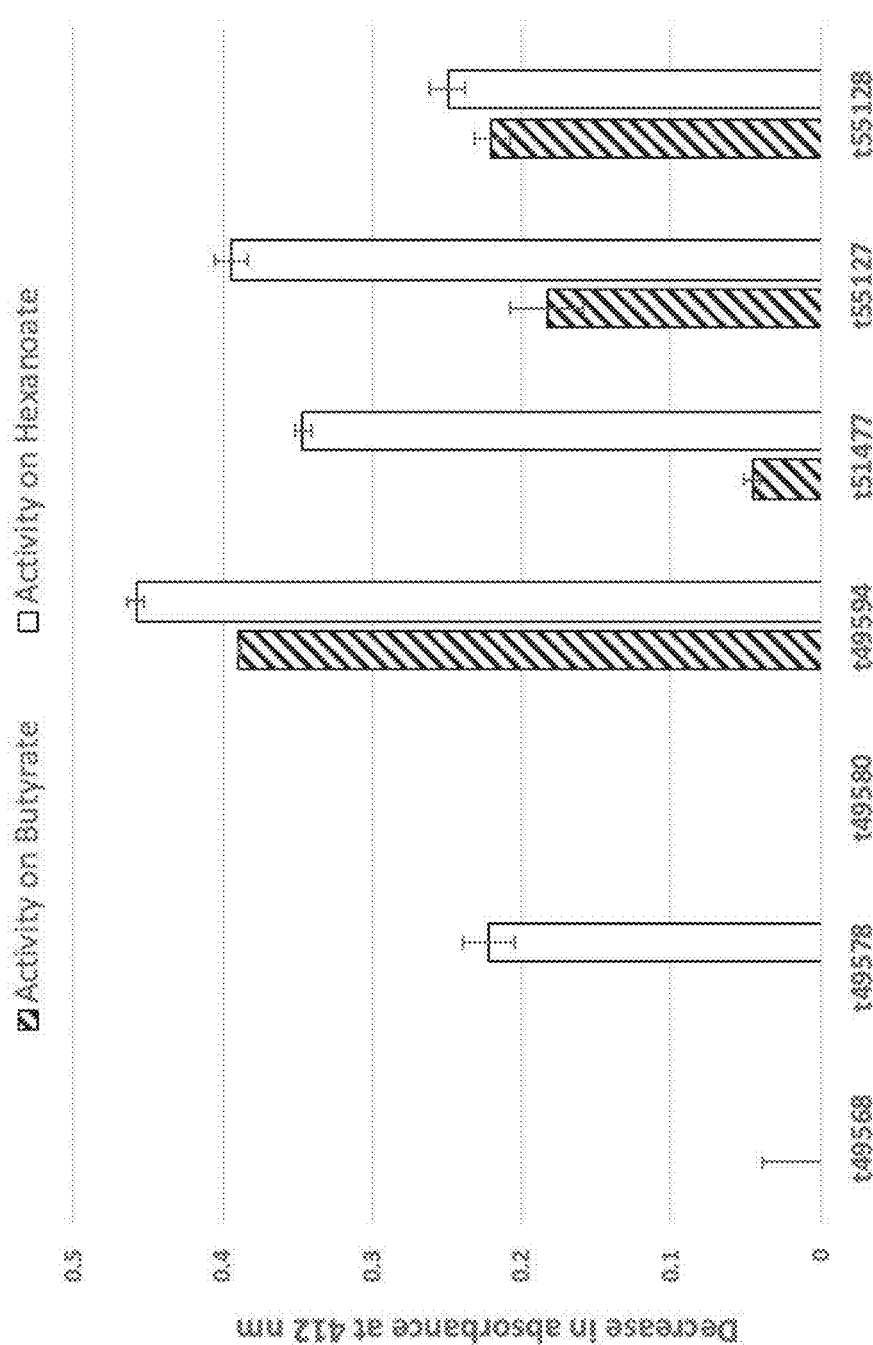
FIG. 4 is a graph showing activity of *E. coli* strains expressing candidate AAEs as measured by a 5,5'-dithiobis-(2-nitrobenzoic acid) ("DTNB") assay. Lysates of *E. coli* expressing candidate AAEs were assayed for ligation activity of free CoA to either butyrate or hexanoate. Activity was quantified by measuring the decrease in absorbance at 412 nm, corresponding to a decrease of free CoA in solution.

Olivetolic acid cyclase from *C. saliva* (CsOAC) is a 101 amino acid enzyme that performs non-decaboxylative cyclization of the tetraketide product of olivetol synthase (FIG. 4 Structure 4a) via aldol condensation to form olivetolic acid (FIG. 4 Structure 6a). CsOAC was identified and characterized by Gagne et al. (PNAS 2012) via transcriptome mining, and its cyclization function was recapitulated in vitro to demonstrate that CsOAC is required for formation of olivetolic acid in *C. sativa*. A crystal structure of the enzyme was published by Yang et al. (FEBS J. 2016 March; 283(6): 1088-106), which revealed that the enzyme is a homodimer and belongs to the α+β barrel (DABB) superfamily of protein folds. CsOAC is the only known plant polyketide cyclase. Multiple fungal Type III polyketide synthases have been identified that perform both polyketide synthase and cyclization functions (Funa et al., J Biol Chem. 2007 May 11; 282(19): 14476-81); however, in plants such a dual function enzyme has not yet been discovered.

A non-limiting example of an amino acid sequence encoding OAC in *C. sativa* is provided by UniProtKB-I6WU39 (SEQ ID NO: 125), which catalyzes the formation of olivetolic acid (OA) from 3,5,7-Trioxododecanoyl-CoA.

The sequence of UniProtKB-I6WU39 (SEQ ID NO: 125) is:

MAVKHLIVLKFKDEITEAQKEEFFKTYVNLVNIIPAMKDVYWGKDVTQKN

KEEGYTHIVEVTFESVETIQDYIIHPAHVGFGDVYRSFWEKLLIFDYTPR

K.

A non-limiting example of a nucleic acid sequence encoding *C. sativa* OAC is:

(SEQ ID NO: 130)
atggcagtgaagcatttgattgtattgaagttcaaagatgaaatcacaga agcccaaaaggaagaattttcaagacgtatgtgaatcttgtgaatatca tcccagccatgaaagatgtatactggggtaaagatgtgactcaaaagaat aaggaagaagggtacactcacatagttgaggtaacatttgagagtgtgga gactattcaggactacattattcatcctgcccatgttggatttggagatg tctatcgttctttctgggaaaaacttctcattttgactacacaccacga aag.

Prenyltransferase (PT)

A host cell described in this application may comprise a prenyltransferase (PT). As used in this application, a "PT" refers to an enzyme that is capable of transferring prenyl groups to acceptor molecule substrates. Non-limiting examples of prenyltransferases are described in WO2018200888 (e.g., CsPT4), U.S. Pat. No. 8,884,100 (e.g., CsPT1); CA2718469; Valliere et al., *Nat Commun*. 2019 Feb. 4; 10(1):565; and Luo et al., *Nature* 2019 March; 567(7746): 123-126, which are incorporated by reference in their entireties. In some embodiments, a PT is capable of producing cannabigerolic acid (CBGA), cannabigerovarinic acid (CBGVA), or other cannabinoids or cannabinoid-like substances. In some embodiments, a PT is cannabigerolic acid synthase (CBGAS). In some embodiments, a PT is cannabigerovarinic acid synthase (CBGVAS).

In some embodiments, the PT is an NphB prenyltransferase. See, e.g., U.S. Pat. No. 7,544,498; and Kumano et al., *Bioorg Med Chem*. 2008 Sep. 1; 16(17): 8117-8126, which are incorporated by reference in this application in their entireties. In some embodiments, a PT corresponds to NphB from *Streptomyces* sp. (see, e.g., UniprotKB Accession No. Q4R2T2; see also SEQ ID NO: 2 of U.S. Pat. No. 7,361, 483). The protein sequence corresponding to UniprotKB Accession No. Q4R2T2 is provided by SEQ ID NO: 131:

(SEQ ID NO: 131)
MSEAADVERVYAAMEEAAGLLGVACARDKIYPLLSTFQDTLVEGGSVVVF

SMASGRHSTELDFSISVPTSHGDPYATVVEKGLFPATGHPVDDLLADTQK

HLPVSMFAIDGEVTGGFKKTYAFFPTDNMPGVAELSAIPSMPPAVAENAE

LFARYGLDKVQMTSMDYKKRQVNLYFSELSAQTLEAESVLALVRELGLHV

PNELGLKFCKRSFSVYPTLNWETGKIDRLCFAVISNDPTLVPSSDEGDIE

KFHNYATKAPYAYVGEKRTLVYGLTLSPKEEYYKLGAYYHITDVQRGLLK

AFDSLED.

A non-limiting example of a nucleic acid sequence encoding NphB is:

(SEQ ID NO: 132)
atgtcagaagccgcagatgtcgaaagagtttacgccgctatggaagagc cgccggtttgttaggtgttgcctgtgccagagataagatctacccattgt tgtctacttttcaagatacattagttgaaggtggttcagttgttgttttc tctatggcttcaggtagacattctacagaattggatttctctatctcagt -continued
```
tccaacatcacatggtgatccatacgctactgttgttgaaaaaggtttat ttccagcaacaggtcatccagttgatgatttgttggctgatactcaaaag catttgccagtttctatgtttgcaattgatggtgaagttactggtggttt caagaaaacttacgctttctttccaactgataacatgccaggtgttgcag aattatctgctattccatcaatgccaccagctgttgcagaaaatgcagaa ttatttgctagatacggtttggataaggttcaaatgacatctatggatta caagaaaagacaagttaatttgtacttttctgaattatcagcacaaactt tggaagctgaatcagttttggcattagttagagaattgggtttacatgtt ccaaacgaatttgggtttgaagttttgtaaaagatctttctcagtttatcc aactttaaactgggaaacaggcaagatcgatagattatgtttcgcagtta tctctaacgatccaacattggttccatcttcagatgaaggtgatatcgaa aagtttcataactacgctactaaagcaccatatgcttacgttggtgaaa gagaacattagtttatggtttgactttatccaccaaaggaagaatactaca agttgggtgcttactaccacattaccgacgtacaaagaggtttattgaaa gcattcgatagtttagaagactaa.
```

In other embodiments, a PT corresponds to CsPT1, which is disclosed as SEQ ID NO:2 in U.S. Pat. No. 8,884,100 (*C. saliva*; corresponding to SEQ ID NO: 110 in this application):

```
                                     (SEQ ID NO: 110)
MGLSSVCTFSFQTNYHTLLNPHNNNPKTSLLCYRHPKTPIKYSYNNFPSK

HCSTKSFHLQNKCSESLSIAKNSIRAATTNQTEPPESDNHSVATKILNFG

KACWKLQRPYTHAFTSCACGLFGKELLHNTNLISWSLMFKAFFFLVAILC

IASFTTTINQIYDLHIDRINKPDLPLASGEISVNTAWIMSIIVALFGLII

TIKMKGGPLYIFGYCFGIFGGIVYSVPPFRWKQNPSTAFLLNFLAHIITN

FTFYYASRAALGLPFELRPSFTFLLAFMKSMGSALALIKDASDVEGDTKF

GISTLASKYGSRNLTLFCSGIVLLSYVAAILAGIIWPQAFNSNVMLLSHA

ILAFWLILQTRDFALTNYDPEAGRRFYEFMWKLYYAEYLVYVFI.
```

In some embodiments, a PT corresponds to CsPT4, which is disclosed as SEQ ID NO:1 in WO2019071000, corresponding to SEQ ID NO: 133 in this application:

```
                                     (SEQ ID NO: 133)
MGLSLVCTFSFQTNYHTLLNPHNKNPKNSLLSYQHPKTPIIKSSYDNFPS

KYCLTKNFHLLGLNSHNRISSQSRSIRAGSDQIEGSPHHESDNSIATKIL

NFGHTCWKLQRPYVVKGMISIACGLFGRELFNNRHLFSWGLMWKAFFALV

PILSFNFFAAIMNQIYDVDIDRINKPDLPLVSGEMSIETAWILSIIVALT

GLIVTIKLKSAPLFVFIYIFGIFAGFAYSVPPIRWKQYPFTNFLITISSH

VGLAFTSYSATTSALGLPFVWRPAFSFIIAFMTVMGMTIAFAKDISDIEG

DAKYGVSTVATKLGARNMTFVVSGVLLLNYLVSISIGIIWPQVFKSNIMI

LSHAILAFCLIFQTRELALANYASAPSRQFFEFIWLLYYAEYFVYVFI.
```

In some embodiments, a PT corresponds to a truncated CsPT4, which is provided as SEQ ID NO: 134 herein:

```
MSAGSDQIEGSPHHESDNSIATKILNFGHTCWKLQRPYVVKGMISIACGL

FGRELFNNRHLFSWGLMWKAFFALVPILSFNFFAAIMNQIYDVDIDRINK

PDLPLVSGEMSIETAWILSIIVALTGLIVTIKLKSAPLFVFIYIFGIFAG

FAYSVPPIRWKQYPFTNFLITISSHVGLAFTSYSATTSALGLPFVWRPAF

SFIIAFMTVMGMTIAFAKDISDIEGDAKYGVSTVATKLGARNMTFVVSGV

LLLNYLVSISIGIIWPQVFKSNIMILSHAILAFCLIFQTRELALANYASA

PSRQFFEFIWLLYYAEYFVYVFI.
```

Functional expression of paralog *C. sativa* CBGAS enzymes in *S. cerevisiae* and production of the major cannabinoid CBGA has been reported (Page and Boubakir US 20120144523, 2012, and Luo et al. Nature, 2019). Luo et al. reported the production of CBGA in *S. cerevisiae* by expressing a truncated version of a *C. sativa* CBGAS, CsPT4, with its native signal peptide removed (Luo et al. *Nature,* 2019). Without being bound by a particular theory, the integral-membrane nature of *C. sativa* CBGAS enzymes may render functional expression of *C. sativa* CBGAS enzymes in heterologous hosts challenging. Removal of transmembrane domain(s) or signal sequences or use of prenyltransferases that are not associated with the membrane and are not integral membrane proteins may facilitate increased interaction between the enzyme and available substrate, for example in the cellular cytosol and/or in organelles that may be targeted using peptides that confer localization.

In some embodiments, the PT is a soluble PT. In some embodiments, the PT is a cytosolic PT. In some embodiments, the PT is a secreted protein. In some embodiments, the PT is not a membrane-associated protein. In some embodiments, the PT is not an integral membrane protein. In some embodiments, the PT does not comprise a transmembrane domain or a predicted transmembrane. In some embodiments, the PT may be primarily detected in the cytosol (e.g., detected in the cytosol to a greater extent than detected associated with the cell membrane). In some embodiments, the PT is a protein from which one or more transmembrane domains have been removed and/or mutated (e.g., by truncation, deletions, substitutions, insertions, and/ or additions) so that the PT localizes or is predicted to localize in the cytosol of the host cell, or to cytosolic organelles within the host cell, or, in the case of bacterial hosts, in the periplasm. In some embodiments, the PT is a protein from which one or more transmembrane domains have been removed or mutated (e.g., by truncation, deletions, substitutions, insertions, and/or additions) so that the PT has increased localization to the cytosol, organelles, or periplasm of the host cell, as compared to membrane localization.

Within the scope of the term "transmembrane domains" are predicted or putative transmembrane domains in addition to transmembrane domains that have been empirically determined. In general, transmembrane domains are characterized by a region of hydrophobicity that facilitates integration into the cell membrane. Methods of predicting whether a protein is a membrane protein or a membrane-associated protein are known in the art and may include, for example, amino acid sequence analysis, hydropathy plots, and/or protein localization assays.

In some embodiments, the PT is a protein from which a signal sequence has been removed and/or mutated so that the PT is not directed to the cellular secretory pathway. In some embodiments, the PT is a protein from which a signal sequence has been removed and/or mutated so that the PT is localized to the cytosol or has increased localization to the cytosol (e.g, as compared to the secretory pathway).

In some embodiments, the PT is a secreted protein. In some embodiments, the PT contains a signal sequence.

In some embodiments, a PT is a fusion protein. For example, a PT may be fused to one or more genes in the metabolic pathway of a host cell. In certain embodiments, a PT may be fused to mutant forms of one or more genes in the metabolic pathway of a host cell.

In some embodiments, a PT described in this application transfers one or more prenyl groups to any of positions 1, 2, 3, 4, or 5 in a compound of Formula (6), shown below:

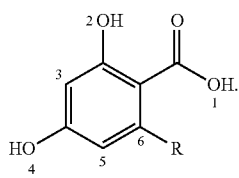

(6)

In some embodiments, the PT transfers a prenyl group to any of positions 1, 2, 3, 4, or 5 in a compound of Formula (6), shown below:

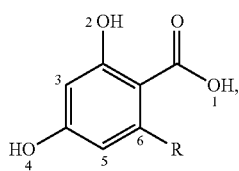

(6)

to form a compound of one or more of Formula (8w), Formula (8x), Formula (8'), Formula (8y), Formula (8z):

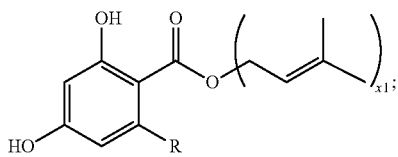

(8w)

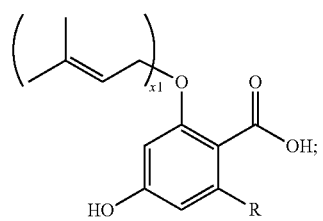

(8x)

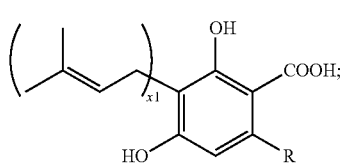

(8')

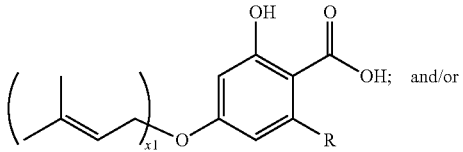

(8y)

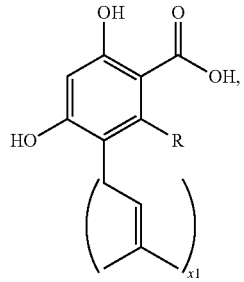

(8z)

or a pharmaceutically acceptable salt, solvate, hydrate, polymorph, co-crystal, tautomer, stereoisomer, isotopically labeled derivative, or prodrug thereof, wherein a is 1, 2, 3, 4, 5, 6, 7, 8, 9, or 10.

Terminal Synthases (TS)

A host cell described in this application may comprise a terminal synthase (TS). As used in this application, a "TS" refers to an enzyme that is capable of catalyzing oxidative cyclization of a prenyl moiety (e.g., terpene) to produce a ring-containing product (e.g, heterocyclic ring-containing product). In certain embodiments, a TS is capable of catalyzing oxidative cyclization of a prenyl moiety (e.g, terpene) to produce a carbocyclic-ring containing product (e.g, cannabinoid). In certain embodiments, a TS is capable of catalyzing oxidative cyclization of a prenyl moiety (e.g, terpene) to produce a heterocyclic-ring containing product (e.g, cannabinoid). In certain embodiments, a TS is capable of catalyzing oxidative cyclization of a prenyl moiety (e.g, terpene) to produce a cannabinoid.

In some embodiments, a TS is a tetrahydrocannabinolic acid synthase (THCAS), a cannabidiolic acid synthase (CBDAS), and/or a cannabichromenic acid synthase (CBCAS). As one of ordinary skill in the art would appreciate a TS could be obtained from any source, including naturally occurring sources and synthetic sources (e.g., a non-naturally occurring TS).

a. Substrates

A TS may be capable of using one or more substrates. In some instances, the location of the prenyl group and/or the R group differs between TS substrates. For example, a TS may be capable of using as a substrate one or more compounds of Formula (8w), Formula (8x), Formula (8'), Formula (8y), and/or Formula (8z):

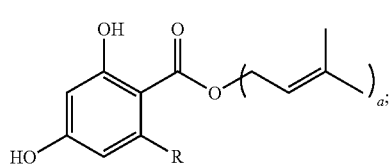

(8w)

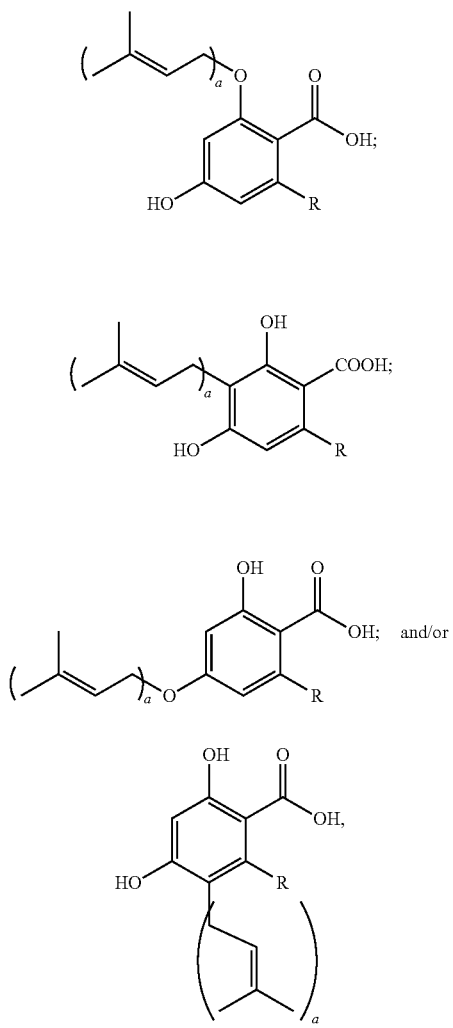

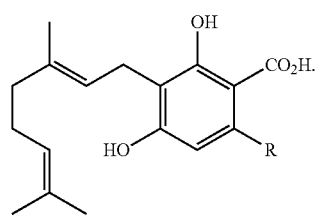

or a pharmaceutically acceptable salt, solvate, hydrate, polymorph, co-crystal, tautomer, stereoisomer, isotopically labeled derivative, or prodrug thereof, wherein a is 1, 2, 3, 4, 5, 6, 7, 8, 9, or 10.

In certain embodiments, a compound of Formula (8') is a compound of Formula (8):

In some embodiments, a TS catalyzes oxidative cyclization of the prenyl moiety (e.g., terpene) of a compound of Formula (8) described in this application and shown in FIG. 2. In certain embodiments, a compound of Formula (8) is a compound of Formula (8a):

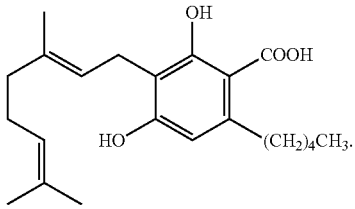

b. Products

In embodiments wherein CBGA is the substrate, the TS enzymes CBDAS, THCAS and CBCAS would generally catalyze the formation of cannabidiolic acid (CBDA), Δ9-tetrahydrocannabinolic acid (THCA) and cannabichromenic acid (CBCA), respectively. However, in some embodiments, a TS can produce more than one different product depending on reaction conditions. For example, the pH of the reaction environment may cause a THCAS or a CBDAS to produce CBCA in greater proportions than THCA or CBDAS, respectively (see, for example, U.S. Pat. No. 9,359,625 to Winnicki and Donsky, incorporated by reference in its entirety).

A TS may be capable of using one or more substrates described in this application to produce one or more products. Non-limiting example of TS products are shown in Table 1. In some instances, a TS is capable of using one substrate to produce 1, 2, 3, 4, 5, 6, 7, 8, 9, or 10 different products. In some embodiments, a TS is capable of using more than one substrate to produce 1, 2, 3, 4, 5, 6, 7, 8, 9, or 10 different products.

In some embodiments, a TS is capable of producing a compound of Formula (X-A) and/or a compound of Formula (X-B):

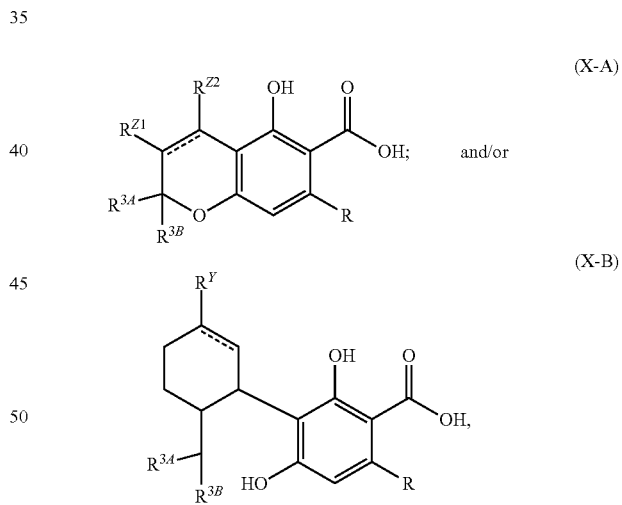

or a pharmaceutically acceptable salt, solvate, hydrate, polymorph, co-crystal, tautomer, stereoisomer, isotopically labeled derivative, or prodrug thereof;

wherein $=\!=$ is a double bond or a single bond, as valency permits;

R is hydrogen, optionally substituted acyl, optionally substituted alkyl, optionally substituted alkenyl, optionally substituted alkynyl, optionally substituted carbocyclyl, or optionally substituted aryl;

$R^{Z1}$ is hydrogen, optionally substituted acyl, optionally substituted alkyl, optionally substituted alkenyl, optionally substituted alkynyl, optionally substituted carbocyclyl, or optionally substituted aryl;

$R^{Z2}$ is hydrogen, optionally substituted acyl, optionally substituted alkyl, optionally substituted alkenyl, optionally substituted alkynyl, optionally substituted carbocyclyl, or optionally substituted aryl;

or optionally, $R^{Z1}$ and $R^{Z2}$ are taken together with their intervening atoms to form an optionally substituted carbocyclic ring;

$R^{3A}$ is hydrogen, optionally substituted acyl, optionally substituted alkyl, optionally substituted alkenyl, or optionally substituted alkynyl;

$R^{3B}$ is hydrogen, optionally substituted acyl, optionally substituted alkyl, optionally substituted alkenyl, or optionally substituted alkynyl; and/or $R^{Y}$ is hydrogen, optionally substituted acyl, optionally substituted alkyl, optionally substituted alkenyl, or optionally substituted alkynyl.

In some embodiments, a compound of Formula (X-A) is:

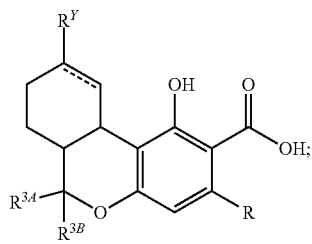

(10-z)

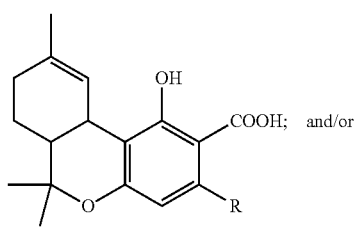

(10)

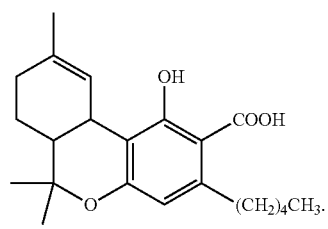

and/or

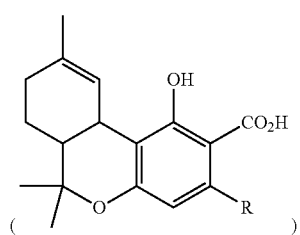

(Tetrahydrocannabinolic acid (THCA))

In certain embodiments, a compound of Formula (10) has a chiral atom labeled with * at carbon 10 and a chiral atom labeled with ** at carbon 6. In certain embodiments, in a compound of Formula (10)

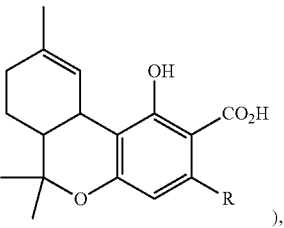

the chiral atom labeled with * at carbon 10 is of the R-configuration or S-configuration; and a chiral atom labeled with ** at carbon 6 is of the R-configuration. In certain embodiments, in a compound of Formula (10)

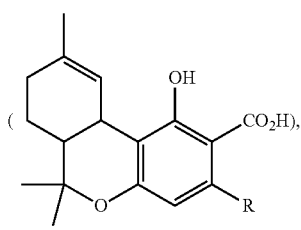

the chiral atom labeled with * at carbon 10 is of the S-configuration; and a chiral atom labeled with ** at carbon 6 is of the R-configuration or S-configuration. In certain embodiments, in a compound of Formula (10)

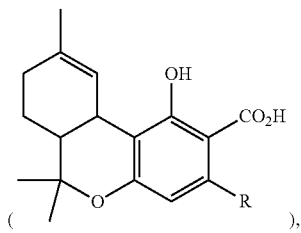

the chiral atom labeled with * at carbon 10 is of the R-configuration and a chiral atom labeled with ** at carbon 6 is of the R-configuration. In certain embodiments, a compound of Formula (10)

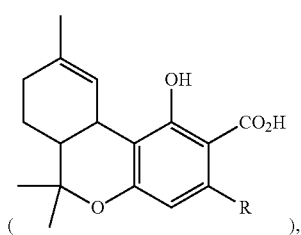

is of the formula:

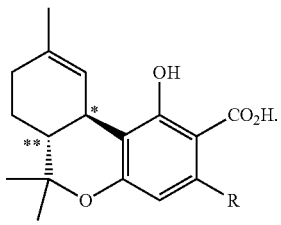

In certain embodiments, in a compound of Formula (10)

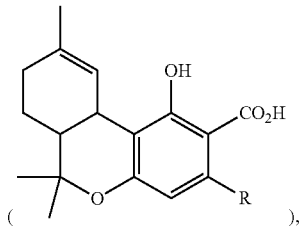

the chiral atom labeled with * at carbon 10 is of the S-configuration and a chiral atom labeled with ** at carbon 6 is of the S-configuration. In certain embodiments, a compound of Formula (10)

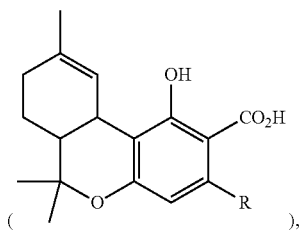

is of the formula:

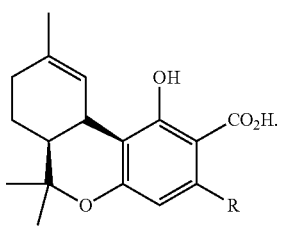

In certain embodiments, a compound of Formula (10a)

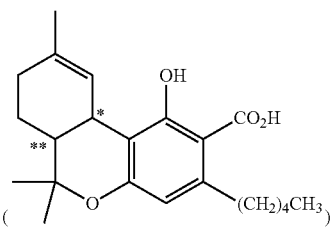

has a chiral atom labeled with * at carbon 10 and a chiral atom labeled with ** at carbon 6. In certain embodiments, in a compound of Formula (10a)

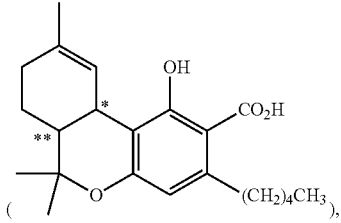

the chiral atom labeled with * at carbon 10 is of the R-configuration or S-configuration; and a chiral atom labeled with ** at carbon 6 is of the R-configuration. In certain embodiments, in a compound of Formula (10a)

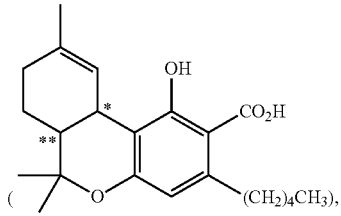

the chiral atom labeled with * at carbon 10 is of the S-configuration; and a chiral atom labeled with ** at carbon 6 is of the R-configuration or S-configuration. In certain embodiments, in a compound of Formula (10a)

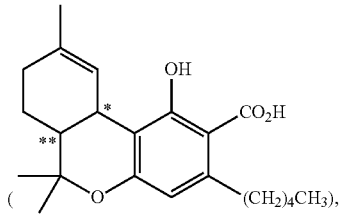

the chiral atom labeled with * at carbon 10 is of the R-configuration and a chiral atom labeled with ** at carbon 6 is of the R-configuration. In certain embodiments, a compound of Formula (10a)

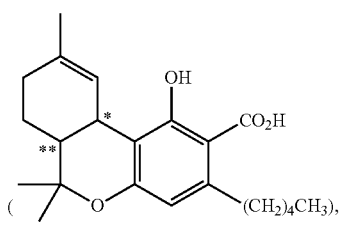

is of the formula:

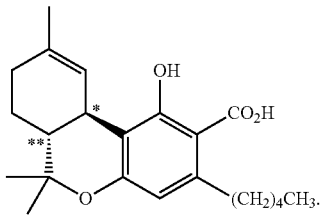

In certain embodiments, in a compound of Formula (10a)

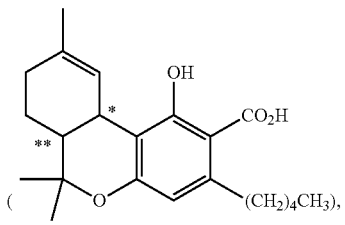

the chiral atom labeled with * at carbon 10 is of the S-configuration and a chiral atom labeled with ** at carbon 6 is of the S-configuration. In certain embodiments, a compound of Formula (10a)

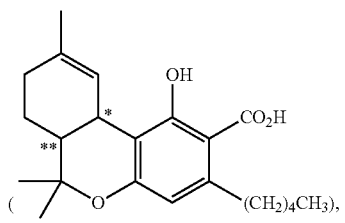

is of the formula:

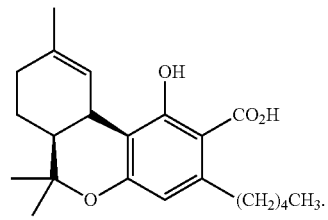

In some embodiments, a compound of Formula (X-A) is:

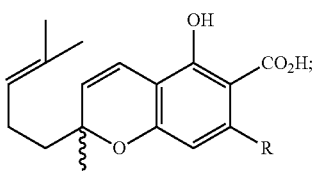

(11)

-continued

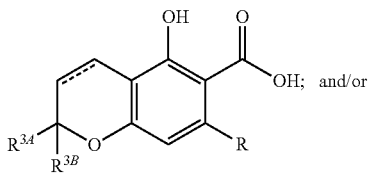

(11-z)

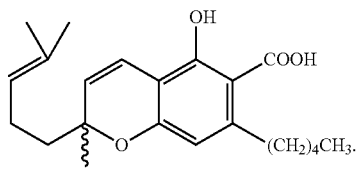

(11a)

(cannabichromenic acid (CBCA))

In some embodiments, a compound of Formula (X-A) is:

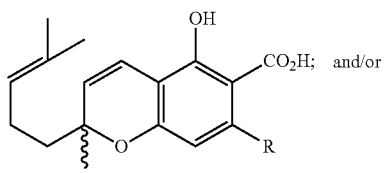

(11)

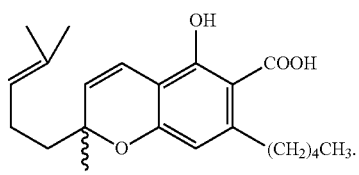

(11a)

(cannabichromenic acid (CBCA))

In some embodiments, a compound of Formula (X-B) is:

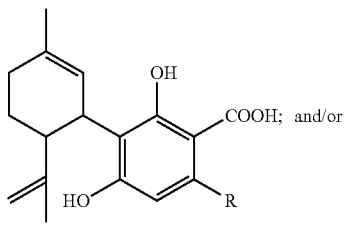

(9)

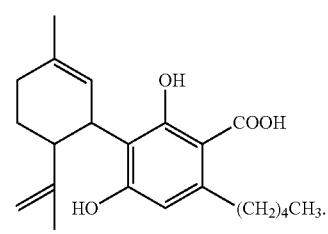

(9a)

(cannabidiolic acid (CBDA))

In certain embodiments, a compound of Formula (9)

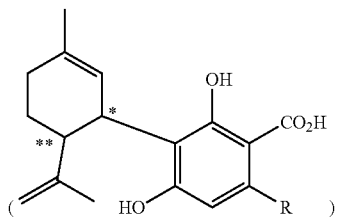

has a chiral atom labeled with * at carbon 3 and a chiral atom labeled with ** at carbon 4. In certain embodiments, in a compound of Formula (9)

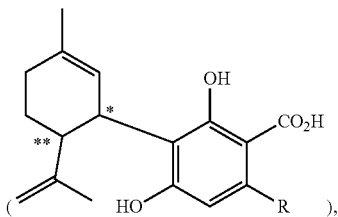

the chiral atom labeled with * at carbon 3 is of the R-configuration or S-configuration; and a chiral atom labeled with ** at carbon 4 is of the R-configuration. In certain embodiments, in a compound of Formula (9)

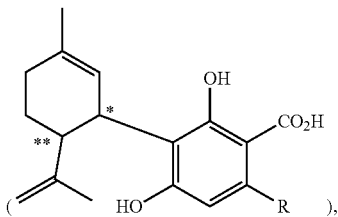

the chiral atom labeled with * at carbon 3 is of the S-configuration; and a chiral atom labeled with ** at carbon 4 is of the R-configuration or S-configuration. In certain embodiments, in a compound of Formula (9)

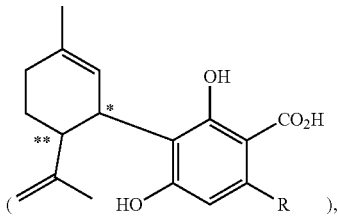

the chiral atom labeled with * at carbon 3 is of the R-configuration and a chiral atom labeled with ** at carbon 4 is of the R-configuration. In certain embodiments, a compound of Formula (9)

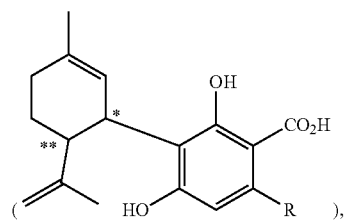

is of the formula:

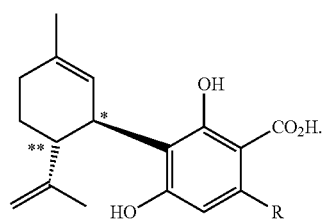

In certain embodiments, in a compound of Formula (9)

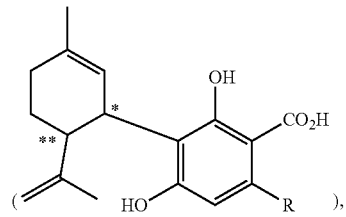

the chiral atom labeled with * at carbon 3 is of the S-configuration and a chiral atom labeled with ** at carbon 4 is of the S-configuration. In certain embodiments, a compound of Formula (9)

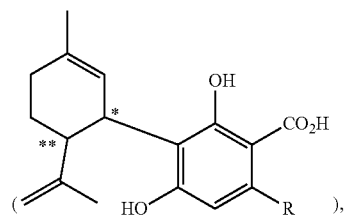

is of the formula:

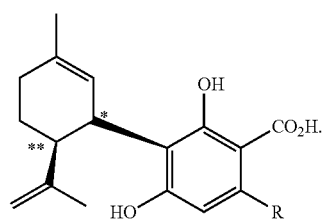

In certain embodiments, a compound of Formula (9a) (CBDA)

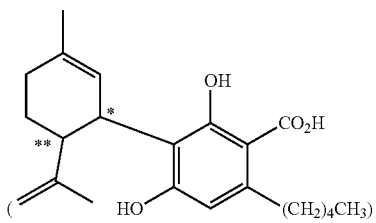

has a chiral atom labeled with * at carbon 3 and a chiral atom labeled with ** at carbon 4. In certain embodiments, in a compound of Formula (9a)

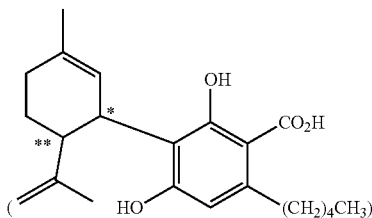

the chiral atom labeled with * at carbon 3 is of the R-configuration or S-configuration; and a chiral atom labeled with ** at carbon 4 is of the R-configuration. In certain embodiments, in a compound of Formula (9a)

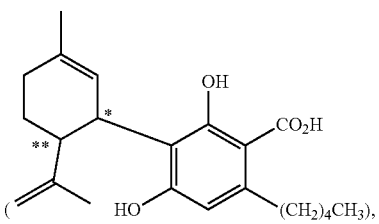

the chiral atom labeled with * at carbon 3 is of the S-configuration; and a chiral atom labeled with ** at carbon 4 is of the R-configuration or S-configuration. In certain embodiments, in a compound of Formula (9a)

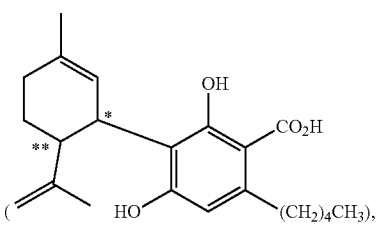

the chiral atom labeled with * at carbon 3 is of the R-configuration and a chiral atom labeled with ** at carbon 4 is of the R-configuration. In certain embodiments, a compound of Formula (9a)

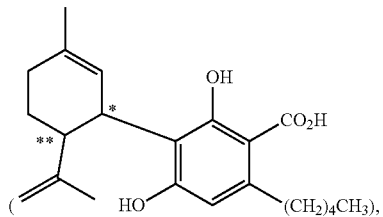

is of the formula:

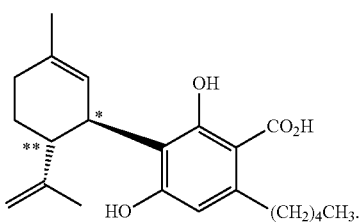

In certain embodiments, in a compound of Formula (9a)

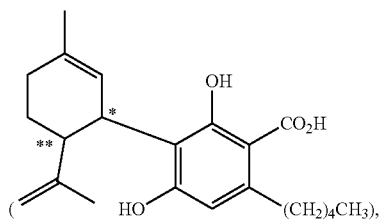

the chiral atom labeled with * at carbon 3 is of the S-configuration and a chiral atom labeled with ** at carbon 4 is of the S-configuration. In certain embodiments, a compound of Formula (9a)

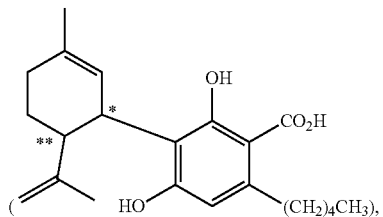

is of the formula:

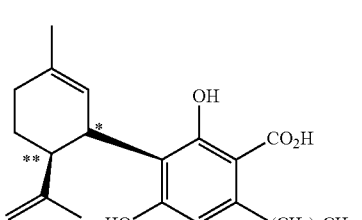

In some embodiments, as shown in FIG. 2, a TS is capable of producing a cannabinoid from the product of a PT, including, without limitation, an enzyme capable of producing a compound of Formula (9), (10), or (11):

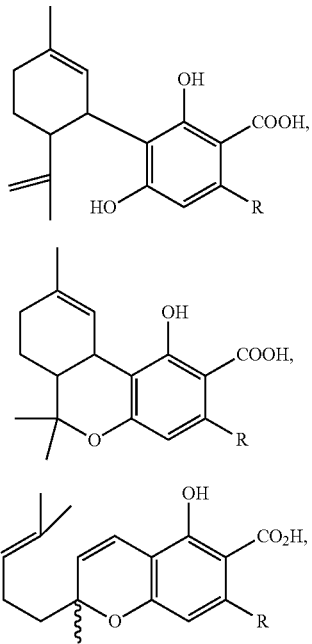

or a pharmaceutically acceptable salt, solvate, hydrate, polymorph, co-crystal, tautomer, stereoisomer, isotopically labeled derivative, or prodrug thereof, wherein R is hydrogen, optionally substituted acyl, optionally substituted alkyl, optionally substituted alkenyl, optionally substituted alkynyl, optionally substituted carbocyclyl, or optionally substituted aryl; produced from a compound of Formula (8'):

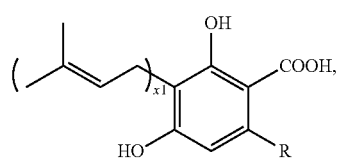

wherein a is 1, 2, 3, 4, 5, 6, 7, 8, 9, or 10; and R is hydrogen, optionally substituted acyl, optionally substituted alkyl, optionally substituted alkenyl, optionally substituted alkynyl, optionally substituted carbocyclyl, or optionally substituted aryl; or using any other substrate. In certain embodiments, a compound of Formula (80 is a compound of Formula (8):

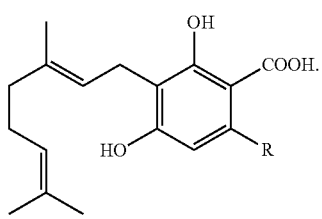

In certain embodiments, a compound of Formula (9), (10), or (11) is produced using a TS from a substrate compound of Formula (8') (e.g., compound of Formula (8)), for example. Non-limiting examples of substrate compounds of Formula (80 include but are not limited to cannabigerolic acid (CBGA), cannabigerovarinic acid (CBGVA), or cannabinerolic acid. In certain embodiments, at least one of the hydroxyl groups of the product compounds of Formula (9), (10), or (11) is further methylated. In certain embodiments, a compound of Formula (9) is methylated to form a compound of Formula (12):

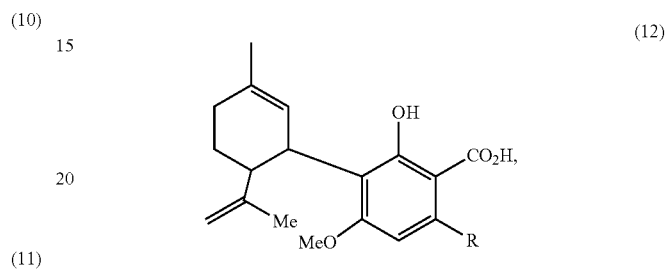

or a pharmaceutically acceptable salt, solvate, hydrate, polymorph, co-crystal, tautomer, stereoisomer, isotopically labeled derivative, or prodrug thereof.

Tetrahydrocannabinolic Acid Synthase (THCAS)

A host cell described in this application may comprise a TS that is a tetrahydrocannabinolic acid synthase (THCAS). As used in this application "tetrahydrocannabinolic acid synthase (THCAS)" or "$\Delta^1$-tetrahydrocannabinolic acid (THCA) synthase" refers to an enzyme that is capable of catalyzing oxidative cyclization of a prenyl moiety (e.g., terpene) of a compound of Formula (8) to produce a ring-containing product (e.g, heterocyclic ring-containing product, carbocyclic-ring containing product) of Formula (10). In certain embodiments, a THCAS refers to an enzyme that is capable of producing $\Delta$9-tetrahydrocannabinolic acid ($\Delta$9-THCA, THCA, A9-Tetrahydro-cannabivarinic acid A ($\Delta$9-THCVA-C3 A), THCVA, THCP, or a compound of Formula 10(a), from a compound of Formula (8). In certain embodiments, a THCAS is capable of producing $\Delta^9$-tetrahydrocannabinolic acid ($\Delta^9$-THCA, THCA, or a compound of Formula 10(a)).

A THCAS may use cannabigerolic acid (CBGA) as a substrate. In some embodiments, the THCAS produces $\Delta^9$-THCA from CBGA. In some embodiments, a THCAS may catalyze the oxidative cyclization of other substrates, such as 3-geranyl-2,4-dihydro-6-alkylbenzoic acids. In some embodiments, a THCAS may catalyze the oxidative cyclization of other substrates, such as 3-geranyl-2,4-dihydro-6-alkylbenzoic acids like cannabigerovarinic acid (CBGVA)). In some embodiments, a THCAS exhibits specificity for CBGA substrates. In some embodiments, a THCAS may use cannabivarinic acid (CBDVA) as a substrate. In some embodiments, the THCAS exhibits specificity for CBDVA substrates. In some embodiments, a THCAS may use cannabiphorol acid (CBDP) as a substrate. In some embodiments, the THCAS exhibits specificity for CBDP substrates.

In some embodiments, a THCAS is from *C. sativa*. *C. sativa* THCAS performs the oxidative cyclization of the geranyl moiety of Cannabigerolic Acid (CBGA) (FIG. 4 Structure 8a) to form Tetrahydrocannabinolic Acid (FIG. 4 Structure 10a) using covalently bound flavin adenine dinucleotide (FAD) as a cofactor and molecular oxygen as the final electron acceptor. THCAS was first discovered and characterized by Taura et al. (JACS. 1995) following extraction of the enzyme from the leaf buds of *C. sativa* and confirmation of its THCA synthase activity in vitro upon the addition of CBGA as a substrate. Additional analysis indicated that the enzyme is a monomer and possesses FAD binding and Berberine Bridge Enzyme (BBE) sequence motifs. A crystal structure of the enzyme published by Shoyama et al. (J Mol Biol. 2012 Oct. 12; 423(1):96-105) revealed that the enzyme covalently binds to a molecule of the cofactor FAD. See also, e.g., Sirikantarams et al., *J. Biol. Chem.* 2004 Sep. 17; 279(38):39767-39774. There are several THCAS isozymes in *Cannabis sativa*.

In some embodiments, a *C. sativa* THCAS (Uniprot KB Accession No.: I1V0C5) comprises the amino acid sequence shown below:

(SEQ ID NO: 135)
MNCSAFSFWFVCKIIFFFLSFNIQISIANPQENFLKCFSEYIPNNPANPK

FIYTQHDQLYMSVLNSTIQNLRFTSDTTPKPLVIVTPSNVSHIQASILCS

KKVGLQIRTRSGGHDAEGMSYISQVPFVVVDLRNMHSIKIDVHSQTAWVE

AGATLGEVYYWINEKNENFSFPGGYCPTVGVGGHFSGGGYGALMRNYGLA

ADNIIDAHLVNVDGKVLDRKSMGEDLFWAIRGGGGENFGIIAAWKIKLVA

VPSKSTIFSVKKNMEIHGLVKLFNKWQNIAYKYDKDLVLMTHFITKNITD

NHGKNKTTVHGYFSSIFHGGVDSLVDLMNKSFPELGIKKTDCKEFSWIDT

TIFYSGVVNFNTANFKKEILLDRSAGKKTAFSIKLDYVKKPIPETAMVKI

LEKLYEEDVGVGMYVLYPYGGIMEEISESAIPFPHRAGIMYELWYTASWE

KQEDNEKHINWVRSVYNFTTPYVSQNPRLAYLNYRDLDLGKTNPESPNNY

TQARIWGEKYFGKNFNRLVKVKTKADPNNFFRNEQSIPPLPPHHH.

In some embodiments, a THCAS comprises the sequence shown below:

(SEQ ID NO: 136)
NPQENFLKCFSEYIPNNPANPKFIYTQHDQLYMSVLNSTIQNLRFTSDTT

PKPLVIVTPSNVSHIQASILCSKKVGLQIRTRSGGHDAEGMSYISQVPFV

VVDLRNMHSIKIDVHSQTAWVEAGATLGEVYYWINEKNENFSFPGGYCPT

VGVGGHFSGGGYGALMRNYGLAADNIIDAHLVNVDGKVLDRKSMGEDLFW

AIRGGGGENFGIIAAWKIKLVAVPSKSTIFSVKKNMEIHGLVKLFNKWQN

IAYKYDKDLVLMTHFITKNITDNHGKNKTTVHGYFSSTHGGVDSLVDLMN

KSFPELGIKKTDCKEFSWIDTTIFYSGVVNFNTANFKKEILLDRSAGKKT

AFSIKLDYVKKPIPETAMVKILEKLYEEDVGVGMYVLYPYGGIMEEISES

AIPFPHRAGIMYELWYTASWEKQEDNEKHINWVRSVYNFTTPYVSQNPRL

AYLNYRDLDLGKTNPESPNNYTQARIWGEKYFGKNFNRLVKVKTKADPNN

FFRNEQSIPPLPPHHH.

A non-limiting example of a nucleotide sequence encoding SEQ ID NO: 136 is:

(SEQ ID NO: 137)
aacccgcaagaaaactttctaaaatgcttttctgaatacattcctaacaa ccctgccaacccgaagtttatctacacacaacacgatcaattgtatatga gcgtgttgaatagtacaatacagaacctgaggtttacatccgacacaacg ccgaaaccgctagtgatcgtcacaccctccaacgtaagccacattcaggc aagcattttatgcagcaagaaagtcggactgcagataaggacgaggtccg gaggacacgacgccgaagggatgagctatatctcccaggtacctttgtgt gtggtagacttgagaaatatgcactctatcaagatagacgttcactccca aaccgcttgggttgaggcgggagccacccttggtgaggtctactactgga tcaacgaaaagaatgaaaattttagctttcctggggatattgcccaact gtaggtgttggcggccacttctcaggaggcggttatgggccttgatgcg taactacggacttgcggccgacaacattatagacgcacatctagtgaatg tagacggcaaagttttagacaggaagagcatgggtgaggatctttttgg gcaattagaggcggaggggagaaaattttggaattatcgctgcttggaa aattaagctagttgcggtaccgagcaaaagcactatattctctgtaaaaa agaacatggagatacatggtttggtgaagcttttaataagtggcaaaac atcgcgtacaagtacgacaaagatctggttctgatgacgcattttataac gaaaaatatcaccgacaaccacggaaaaaacaaaaccacagtacatggct acttctctagtatatttcatgggggagtcgattctctggttgatttaatg aacaaatcattcccagagttgggtataaagaagacagactgtaaggagtt ctcttggattgacacaactatattctattcaggcgtagtcaacttaaca cggcgaatttcaaaaaagagatccttctggacagatccgcaggtaagaaa actgcgttctctatcaaattggactatgtgaagaagcctattcccgaaac cgcgatggtcaagatacttgagaaattatacgaggaagatgtgggagttg gaatgtacgtactttatccctatggtgggataatggaagaaatcagcgag agcgccattccatttccccatcgtgccggcatcatgtacgagctgtggta tactgcgagttgggagaagcaagaagacaacgaaaagcacattaactggg tcagatcagtttacaatttcaccaccccatacgtgtcccagaatccgcgt ctggcttacttgaactaccgtgatcttgacctgggtaaaacgaacccgga gtcacccaacaattacactcaagctagaatctggggagagaaatactttg ggaagaacttcaacaggttagtaaaggttaaaaccaaggcagatccaaac aactttttagaaatgaacaatccattccccgctacccccgcaccatca c.

In some embodiments, a *C. saliva* THCAS comprises the amino acid sequence set forth in UniProtKB-Q8GTB6 (SEQ ID NO: 112):

MNCSAFSFWFVCKIIFFFLSFHIQISIANPRENFLKCFSKHIPNNVANPK

LVYTQHDQLYMSILNSTIQNLRFISDTTPKPLVIVTPSNNSHIQATILCS

KKVGLQIRTRSGGHDAEGMSYISQVPFVVVDLRNMHSIKIDVHSQTAWVE

AGATLGEVYYWINEKNENLSFPGGYCPTVGVGGHFSGGGYGALMRNYGLA

ADNIIDAHLVNVDGKVLDRKSMGEDLFWAIRGGGGENFGIIAAWKIKLVA

VPSKSTIFSVKKNMEIHGLVKLFNKWQNIAYKYDKDLVLMTHFITKNITD

NHGKNKTTVHGYFSSIFHGGVDSLVDLMNKSFPELGIKKTDCKEFSWIDT

```
-continued
TIFYSGVVNFNTANFKKEILLDRSAGKKTAFSIKLDYVKKPIPETAMVKI

LEKLYEEDVGAGMYVLYPYGGIMEEISESAIPFPHRAGIMYELWYTASWE

KQEDNEKHINWVRSVYNFTTPYVSQNPRLAYLNYRDLDLGKTNHASPNNY

TQARIWGEKYFGKNFNRLVKVKTKVDPNNFFRNEQSIPPLPPHHH.
```

Additional non-limiting examples of THCAS enzymes may also be found in U.S. Pat. No. 9,512,391 and US Publication No. 2018/0179564, which are incorporated by reference in this application in their entireties.

Cannabidiolic Acid Synthase (CBDAS)

A host cell described in this application may comprise a TS that is a cannabidiolic acid synthase (CBDAS). As used in this application, a "CBDAS" refers to an enzyme that is capable of catalyzing oxidative cyclization of a prenyl moiety (e.g., terpene) of a compound of Formula (8) to produce a compound of Formula 9. In some embodiments, a compound of Formula 9 is a compound of Formula (9a) (cannabidiolic acid (CBDA)), CBDVA, or CBDP. A CBDAS may use cannabigerolic acid (CBGA) or cannabinerolic acid as a substrate. In some embodiments, a cannabidiolic acid synthase is capable of oxidative cyclization of cannabigerolic acid (CBGA) to produce cannabidiolic acid (CBDA). In some embodiments, the CBDAS may catalyze the oxidative cyclization of other substrates, such as 3-geranyl-2,4-dihydro-6-alkylbenzoic acids like cannabigerovarinic acid (CBVGA). In some embodiments, the CBDAS exhibits specificity for CBGA substrates.

In some embodiments, a CBDAS is from *Cannabis*. In *C. sativa*, CBDAS is encoded by the CBDAS gene and is a flavoenzyme. A non-limiting example of an amino acid sequence encoding CBDAS is provided by UniProtKB-A6P6V9 (SEQ ID NO: 111) from *C. sativa*:

```
MKCSTFSFWFVCKIIFFFFSFNIQTSIANPRENFLKCFSQYIPNNATNLK

LVYTQNNPLYMSVLNSTIHNLRFTSDTTPKPLVIVTPSHVSHIQGTILCS

KKVGLQIRTRSGGHDSEGMSYISQVPFVIVDLRNMRSIKIDVHSQTAWVE

AGATLGEVYYWVNEKNENLSLAAGYCPTVCAGGHFGGGGYGPLMRNYGLA

ADNIIDAHLVNVHGKVLDRKSMGEDLFWALRGGGAESFGIIVAWKIRLVA

VPKSTMFSVKKIMEIHELVKLVNKWQNIAYKYDKDLLLMTHFITRNITDN

QGKNKTAIHTYFSSVFLGGVDSLVDLMNKSFPELGIKKTDCRQLSWIDTI

IFYSGVVNYDTDNFNKEILLDRSAGQNGAFKIKLDYVKKPIPESVFVQIL

EKLYEEDIGAGMYALYPYGGIMDEISESAIPFPHRAGILYELWYICSWEK

QEDNEKHLNWIRNIYNFMTPYVSKNPRLAYLNYRDLDIGINDPKNPNNYT

QARIWGEKYFGKNFDRLVKVKTLVDPNNFFRNEQSIPPLPRHRH.
```

Additional non-limiting examples of CBDAS enzymes may also be found in U.S. Pat. No. 9,512,391 and US Publication No. 2018/0179564, which are incorporated by reference in this application in their entireties.

Cannabichromenic Acid Synthase (CBCAS)

A host cell described in this application may comprise a TS that is a cannabichromenic acid synthase (CBCAS). As used in this application, a "CBCAS" refers to an enzyme that is capable of catalyzing oxidative cyclization of a prenyl moiety (e.g., terpene) of a compound of Formula (8) to produce a compound of Formula (11). In some embodiments, a compound of Formula (11) is a compound of Formula (11a) (cannabichromenic acid (CBCA)), CBCVA, or CBCPA. A CBCAS may use cannabigerolic acid (CBGA) as a substrate. In some embodiments, a CBCAS produces cannabichromenic acid (CBCA) from cannabigerolic acid (CBGA). In some embodiments, the CBCAS may catalyze the oxidative cyclization of other substrates, such as 3-geranyl-2,4-dihydro-6-alkylbenzoic acids like cannabigerovarinic acid (CBVGA), or CBCPA. In some embodiments, the CBCAS exhibits specificity for CBGA substrates.

In some embodiments, a CBCAS is from *Cannabis*. In *C. sativa*, an amino acid sequence encoding CBCAS is provided by, and incorporated by reference from, SEQ ID NO:2 disclosed in U.S. Patent Publication No. 20170211049. In other embodiments, a CBCAS may be a THCAS described in and incorporated by reference from U.S. Pat. No. 9,359, 625. SEQ ID NO:2 disclosed in U.S. Patent Publication No. 20170211049 (corresponding to SEQ ID NO: 113 in this application) has the amino acid sequence:

```
MNCSTFSFWFVCKIIFFFLSFNIQISIANPQENFLKCFSEYIPNNPANPK

FIYTQHDQLYMSVLNSTIQNLRFTSDTTPKPLVIVTPSNVSHIQASILCS

KKVGLQIRTRSGGHDAEGLSYISQVPFAIVDLRNMHTVKVDIHSQTAWVE

AGATLGEVYYWINEMNENFSFPGGYCPTVGVGGHFSGGGYGALMRNYGLA

ADNIIDAHLVNVDGKVLDRKSMGEDLFWAIRGGGGENFGIIAACKIKLVV

VPSKATIFSVKKNMEIHGLVKLFNKWQNIAYKYDKDLMLTTHFRTRNITD

NHGKNKTTVHGYFSSIFLGGVDSLVDLMNKSFPELGIKKTDCKELSWIDT

TIFYSGVVNYNTANFKKEILLDRSAGKKTAFSIKLDYVKKLIPETAMVKI

LEKLYEEEVGVGMYVLYPYGGIMDEISESAIPFPHRAGIMYELWYTATWE

KQEDNEKHINWVRSVYNFTTPYVSQNPRLAYLNYRDLDLGKTNPESPNNY

TQARIWGEKYFGKNFNRLVKVKTKADPNNFFRNEQSIPPLPPRHH.
```

Any of the enzymes, host cells, and methods described in this application may be used for the production of cannabinoids and cannabinoid precursors, such as those provided in Table 1. In general, the term "production" is used to refer to the generation of one or more products (e.g., products of interest and/or by-products/off-products), for example, from a particular substrate or reactant. The amount of production may be evaluated at any one or more steps of a pathway, such as a final product or an intermediate product, using metrics familiar to one of ordinary skill in the art. For example, the amount of production may be assessed for a single enzymatic reaction (e.g., conversion of a compound of Formula (8) to a compound of Formula (10) by a TS). Alternatively or in addition, the amount of production may be assessed for a series of enzymatic reactions (e.g., the biosynthetic pathway shown in FIG. 1 and/or FIG. 2). Production may be assessed by any metrics known in the art, for example, by assessing volumetric productivity, enzyme kinetics/reaction rate, specific productivity biomass-specific productivity, titer, yield, and total titer of one or more products (e.g, products of interest and/or by-products/off-products).

In some embodiments, the metric used to measure production may depend on whether a continuous process is being monitored (e.g, several cannabinoid biosynthesis steps are used in combination) or whether a particular end product is being measured. For example, in some embodiments, metrics used to monitor production by a continuous process may include volumetric productivity, enzyme kinetics and reaction rate. In some embodiments, metrics used to monitor production of a particular product may include specific productivity, biomass-specific productivity, titer, yield, and/or total titer of one or more products (e.g., products of interest and/or by-products/off-products).

Production of one or more products (e.g., products of interest and/or by-products/off-products) may be assessed indirectly, for example by determining the amount of a substrate remaining following termination of the reaction/fermentation. For example, for a TS that catalyzes the formation of products (e.g., a compound of Formula (10), including tetrahydrocannabinolic acid (THCA) (Formula (10a)) from a compound of Formula (8), including CBGA (Formula 8(a))), production of the products may be assessed by quantifying the compound of Formula (10) directly or by quantifying the amount of substrate remaining following the reaction (e.g., amount of the compound of Formula (8)).

Variants

Aspects of the disclosure relate to nucleic acids encoding any of the polypeptides (e.g., AAE, PKS, PKC, PT, or TS) described in this application. In some embodiments, a nucleic acid encompassed by the disclosure is a nucleic acid that hybridizes under high or medium stringency conditions to a nucleic acid encoding an AAE, PKS, PKC, PT, or TS and is biologically active. For example, high stringency conditions of 0.2 to 1×SSC at 65° C. followed by a wash at 0.2×SSC at 65° C. can be used. In some embodiments, a nucleic acid encompassed by the disclosure is a nucleic acid that hybridizes under low stringency conditions to a nucleic acid encoding an AAE, PKS, PKC, PT, or TS and is biologically active. For example, low stringency conditions of 6×SSC at room temperature followed by a wash at 2×SSC at room temperature can be used. Other hybridization conditions include 3×SSC at 40 or 50° C., followed by a wash in 1 or 2×SSC at 20, 30, 40, 50, 60, or 65° C.

Hybridizations can be conducted in the presence of formaldehyde, e.g., 10%, 20%, 30% 40% or 50%, which further increases the stringency of hybridization. Theory and practice of nucleic acid hybridization is described, e.g., in S. Agrawal (ed.) Methods in Molecular Biology, volume 20; and Tijssen (1993) Laboratory Techniques in biochemistry and molecular biology-hybridization with nucleic acid probes, e.g., part I chapter 2 "Overview of principles of hybridization and the strategy of nucleic acid probe assays," Elsevier, New York provide a basic guide to nucleic acid hybridization.

Variants of enzyme sequences described in this application (e.g, AAE, PKS, PKC, PT, or TS, including nucleic acid or amino acid sequences) are also encompassed by the present disclosure. A variant may share at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity with a reference sequence, including all values in between.

Unless otherwise noted, the term "sequence identity," as known in the art, refers to a relationship between the sequences of two polypeptides or polynucleotides, as determined by sequence comparison (alignment). In some embodiments, sequence identity is determined across the entire length of a sequence (e.g, AAE, PKS, PKC, PT, or TS sequence). In some embodiments, sequence identity is determined over a region (e.g., a stretch of amino acids or nucleic acids, e.g., the sequence spanning an active site) of a sequence (e.g, AAE, PKS, PKC, PT, or TS sequence).

Identity can also refer to the degree of sequence relatedness between two sequences as determined by the number of matches between strings of two or more residues (e.g, nucleic acid or amino acid residues). Identity measures the percent of identical matches between the smaller of two or more sequences with gap alignments (if any) addressed by a particular mathematical model, algorithms, or computer program.

Identity of related polypeptides or nucleic acid sequences can be readily calculated by any of the methods known to one of ordinary skill in the art. The "percent identity" of two sequences (e.g., nucleic acid or amino acid sequences) may, for example, be determined using the algorithm of Karlin and Altschul *Proc. Natl. Acad. Set. USA* 87:2264-68, 1990, modified as in Karlin and Altschul *Proc. Natl. Acad. Sci. USA* 90:5873-77, 1993. Such an algorithm is incorporated into the NBLAST® and XBLAST® programs (version 2.0) of Altschul et al., *J. Mol. Biol.* 215:403-10, 1990. BLAST® protein searches can be performed, for example, with the XBLAST program, score=50, wordlength=3 to obtain amino acid sequences homologous to the proteins described in this application. Where gaps exist between two sequences, Gapped BLAST® can be utilized, for example, as described in Altschul et al., *Nucleic Acids Res.* 25(17): 3389-3402, 1997. When utilizing BLAST® and Gapped BLAST® programs, the default parameters of the respective programs (e.g., XBLAST® and NBLAST®) can be used, or the parameters can be adjusted appropriately as would be understood by one of ordinary skill in the art.

Another local alignment technique which may be used, for example, is based on the Smith-Waterman algorithm (Smith, T. F. & Waterman, M. S. (1981) "Identification of common molecular subsequences." *J. Mol. Biol.* 147:195-197). A general global alignment technique which may be used, for example, is the Needleman-Wunsch algorithm (Needleman, S. B. & Wunsch, C. D. (1970) "A general method applicable to the search for similarities in the amino acid sequences of two proteins." *J. Mol. Biol.* 48:443-453), which is based on dynamic programming.

More recently, a Fast Optimal Global Sequence Alignment Algorithm (FOGSAA) was developed that purportedly produces global alignment of nucleic acid and amino acid sequences faster than other optimal global alignment methods, including the Needleman-Wunsch algorithm. In some embodiments, the identity of two polypeptides is determined by aligning the two amino acid sequences, calculating the number of identical amino acids, and dividing by the length of one of the amino acid sequences. In some embodiments, the identity of two nucleic acids is determined by aligning the two nucleotide sequences and calculating the number of identical nucleotide and dividing by the length of one of the nucleic acids.

For multiple sequence alignments, computer programs including Clustal Omega (Sievers et al., *Mol Syst Biol.* 2011 Oct. 11; 7:539) may be used.

It should be appreciated that a sequence, including a nucleic acid or amino acid sequence, may be found to have a specified percent identity to a reference sequence, such as a sequence disclosed in this application and/or recited in the claims, using any method known to one of ordinary skill in the art. Different algorithms may yield different percent identity values for a given set of sequences. The claims of this application should be understood to encompass sequences for which percent identity to a reference sequence is calculated using default parameters and/or parameters typically used by the skilled artisan for a given algorithm.

In some embodiments, a sequence, including a nucleic acid or amino acid sequence, is found to have a specified percent identity to a reference sequence, such as a sequence disclosed in this application and/or recited in the claims when sequence identity is determined using the algorithm of Karlin and Altschul *Proc. Natl Acad. Set. USA* 87:2264-68, 1990, modified as in Karlin and Altschul *Proc. Natl. Acad. Set. USA* 90:5873-77, 1993 (e.g., BLAST®, NBLAST®, XBLAST® or Gapped BLAST® programs, using default parameters of the respective programs).

In some embodiments, a sequence, including a nucleic acid or amino acid sequence, is found to have a specified percent identity to a reference sequence, such as a sequence disclosed in this application and/or recited in the claims when sequence identity is determined using the Smith-Waterman algorithm (Smith, T. F. & Waterman, M. S. (1981) "Identification of common molecular subsequences." *J. Mol. Biol.* 147:195-197) or the Needleman-Wunsch algorithm (Needleman, S. B. & Wunsch, C. D. (1970) "A general method applicable to the search for similarities in the amino acid sequences of two proteins." J. Mol. Biol. 48:443-453).

In some embodiments, a sequence, including a nucleic acid or amino acid sequence, is found to have a specified percent identity to a reference sequence, such as a sequence disclosed in this application and/or recited in the claims when sequence identity is determined using a Fast Optimal Global Sequence Alignment Algorithm (FOGSAA).

In some embodiments, a sequence, including a nucleic acid or amino acid sequence, is found to have a specified percent identity to a reference sequence, such as a sequence disclosed in this application and/or recited in the claims when sequence identity is determined using Clustal Omega (Sievers et al., *Mol Syst Biol.* 2011 Oct. 11; 7:539).

As used in this application, a residue (such as a nucleic acid residue or an amino acid residue) in sequence "X" is referred to as corresponding to a position or residue (such as a nucleic acid residue or an amino acid residue) "Z" in a different sequence "Y" when the residue in sequence "X" is at the counterpart position of "Z" in sequence "Y" when sequences X and Y are aligned using amino acid sequence alignment tools known in the art.

As used in this application, variant sequences may be homologous sequences. As used in this application, homologous sequences are sequences (e.g., nucleic acid or amino acid sequences) that share a certain percent identity (e.g., at least 5%, at least 10%, at least 15%, at least 20%, at least 25%, at least 30%, at least 35%, at least 40%, at least 45%, at least 50%, at least 55%, at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% percent identity, including all values in between). Homologous sequences include but are not limited to paralogous or orthologous sequences. Paralogous sequences arise from duplication of a gene within a genome of a species, while orthologous sequences diverge after a speciation event.

In some embodiments, a polypeptide variant (e.g, AAE, PKS, PKC, PT, or TS enzyme variant) comprises a domain that shares a secondary structure (e.g, alpha helix, beta sheet) with a reference polypeptide (e.g, a reference AAE, PKS, PKC, PT, or TS enzyme). In some embodiments, a polypeptide variant (e.g, AAE, PKS, PKC, PT, or TS enzyme variant) shares a tertiary structure with a reference polypeptide (e.g, a reference AAE, PKS, PKC, PT, or TS enzyme). As a non-limiting example, a polypeptide variant (e.g, AAE, PKS, PKC, PT, or TS enzyme) may have low primary sequence identity (e.g., less than 80%, less than 75%, less than 70%, less than 65%, less than 60%, less than 55%, less than 50%, less than 45%, less than 40%, less than 35%, less than 30%, less than 25%, less than 20%, less than 15%, less than 10%, or less than 5% sequence identity) compared to a reference polypeptide, but share one or more secondary structures (e.g., including but not limited to loops, alpha helices, or beta sheets), or have the same tertiary structure as a reference polypeptide. For example, a loop may be located between a beta sheet and an alpha helix, between two alpha helices, or between two beta sheets. Homology modeling may be used to compare two or more tertiary structures.

Functional variants of the recombinant AAE, PKS, PKC, PT, or TS enzyme disclosed in this application are encompassed by the present disclosure. For example, functional variants may bind one or more of the same substrates or produce one or more of the same products. Functional variants may be identified using any method known in the art. For example, the algorithm of Karlin and Altschul *Proc. Natl. Acad. Set. USA* 87:2264-68, 1990 described above may be used to identify homologous proteins with known functions.

Putative functional variants may also be identified by searching for polypeptides with functionally annotated domains. Databases including Pfam (Sonnhammer et al, *Proteins.* 1997 July; 28(3):405-20) may be used to identify polypeptides with a particular domain.

Homology modeling may also be used to identify amino acid residues that are amenable to mutation (e.g., substitution, deletion, and/or insertion) without affecting function. A non-limiting example of such a method may include use of position-specific scoring matrix (PSSM) and an energy minimization protocol.

Position-specific scoring matrix (PSSM) uses a position weight matrix to identify consensus sequences (e.g, motifs). PSSM can be conducted on nucleic acid or amino acid sequences. Sequences are aligned and the method takes into account the observed frequency of a particular residue (e.g, an amino acid or a nucleotide) at a particular position and the number of sequences analyzed. See, e.g., Stormo et al., *Nucleic Acids Res.* 1982 May 11; 10(9):2997-3011. The likelihood of observing a particular residue at a given position can be calculated. Without being bound by a particular theory, positions in sequences with high variability may be amenable to mutation (e.g., substitution, deletion, and/or insertion; e.g., PSSM score$\geq$0) to produce functional homologs.

PSSM may be paired with calculation of a Rosetta energy function, which determines the difference between the wild-type and the single-point mutant. The Rosetta energy function calculates this difference as ($\Delta\Delta G_{calc}$). With the Rosetta function, the bonding interactions between a mutated residue and the surrounding atoms are used to determine whether an amino acid substitution, deletion, or insertion increases or decreases protein stability. For example, an amino acid substitution, deletion, or insertion that is designated as favorable by the PSSM score (e.g. PSSM score$\geq$0), can then be analyzed using the Rosetta energy function to determine the potential impact of the amino acid substitution, deletion, or insertion on protein stability. Without being bound by a particular theory, potentially stabilizing amino acid substitutions, deletions, or insertions are desirable for protein engineering (e.g., production of functional homologs). In some embodiments, a potentially stabilizing amino acid substitution, deletion, or insertion has a $\Delta\Delta G_{calc}$ value of less than −0.1 (e.g., less than −0.2, less than −0.3, less than −0.35, less than −0.4, less than −0.45, less than −0.5, less than −0.55, less than −0.6, less than −0.65, less than −0.7, less than −0.75, less than −0.8, less than −0.85, less than −0.9, less than −0.95, or less than −1.0) Rosetta energy units (R.e.u.). See, e.g, Goldenzweig et al., Mol Cell 2016 Jul. 21; 63(2):337-346. Doi: 10.1016/j.molcel.2016.06.012.

In some embodiments, an AAE, PKS, PKC, PT, or TS enzyme coding sequence comprises an amino acid substitution, deletion, and/or insertion at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more than 100 positions corresponding to a reference (e.g., AAE, PKS, PKC, PT, or TS enzyme) coding sequence. In some embodiments, the AAE, PKS, PKC, PT, or TS enzyme coding sequence comprises an amino acid substitution, deletion, and/or insertion in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more codons of the coding sequence relative to a reference (e.g., AAE, PKS, PKC, PT, or TS enzyme) coding sequence. As will be understood by one of ordinary skill in the art, a substitution, insertion, or deletion within a codon may or may not change the amino acid that is encoded by the codon due to degeneracy of the genetic code. In some embodiments, the one or more substitutions, insertions, or deletions in the coding sequence do not alter the amino acid sequence of the coding sequence (e.g., AAE, PKS, PKC, PT, or TS enzyme) relative to the amino acid sequence of a reference polypeptide (e.g, AAE, PKS, PKC, PT, or TS enzyme).

In some embodiments, the one or more substitutions, deletions, and/or insertions in a recombinant AAE, PKS, PKC, PT, or TS enzyme sequence alters the amino acid sequence of the polypeptide (e.g, AAE, PKS, PKC, PT, or TS enzyme) relative to the amino acid sequence of a reference polypeptide (e.g., AAE, PKS, PKC, PT, or TS enzyme). In some embodiments, the one or more substitutions, insertions, or deletions alters the amino acid sequence of the recombinant polypeptide (e.g., AAE, PKS, PKC, PT, or TS enzyme) relative to the amino acid sequence of a reference polypeptide (e.g., AAE, PKS, PKC, PT, or TS enzyme) and alters (enhances or reduces) an activity of the polypeptide relative to the reference polypeptide.

The activity (e.g, specific activity) of any of the recombinant polypeptides described in this application (e.g., AAE, PKS, PKC, PT, or TS enzyme) may be measured using routine methods. As a non-limiting example, a recombinant polypeptide's activity may be determined by measuring its substrate specificity, product(s) produced, the concentration of product(s) produced, or any combination thereof. As used in this application, "specific activity" of a recombinant polypeptide refers to the amount (e.g, concentration) of a particular product produced for a given amount (e.g, concentration) of the recombinant polypeptide per unit time.

The skilled artisan will also realize that insertions, substitutions, or deletions in a recombinant polypeptide (e.g., AAE, PKS, PKC, PT, or TS enzyme) coding sequence may result in conservative amino acid substitutions to provide functionally equivalent variants of the foregoing polypeptides, e.g., variants that retain the activities of the polypeptides. As used in this application, a "conservative amino acid substitution" refers to an amino acid substitution that does not alter the relative charge or size characteristics or functional activity of the protein in which the amino acid substitution is made.

In some instances, an amino acid is characterized by its R group (see, e.g., Table 3). For example, an amino acid may comprise a nonpolar aliphatic R group, a positively charged R group, a negatively charged R group, a nonpolar aromatic R group, or a polar uncharged R group. Non-limiting examples of an amino acid comprising a nonpolar aliphatic R group include alanine, glycine, valine, leucine, methionine, and isoleucine. Non-limiting examples of an amino acid comprising a positively charged R group includes lysine, arginine, and histidine. Non-limiting examples of an amino acid comprising a negatively charged R group include aspartate and glutamate. Non-limiting examples of an amino acid comprising a nonpolar, aromatic R group include phenylalanine, tyrosine, and tryptophan. Non-limiting examples of an amino acid comprising a polar uncharged R group include serine, threonine, cysteine, proline, asparagine, and glutamine.

Non-limiting examples of functionally equivalent variants of polypeptides may include conservative amino acid substitutions in the amino acid sequences of proteins disclosed in this application. As used in this application "conservative substitution" is used interchangeably with "conservative amino acid substitution" and refers to any one of the amino acid substitutions provided in Table 2.

In some embodiments, 1, 2, 3, 4, 5, 6, 7, 8, 9, 10, 11, 12, 13, 14, 15, 16, 17, 18, 19, 20 or more than 20 residues can be changed when preparing variant polypeptides. In some embodiments, amino acids are replaced by conservative amino acid substitutions.

TABLE 2

Conservative Amino Acid Substitutions

| Original Residue | R Group Type | Conservative Amino Acid Substitutions |
|---|---|---|
| Ala | nonpolar aliphatic R group | Cys, Gly, Ser |
| Arg | positively charged R group | His, Lys |
| Asn | polar uncharged R group | Asp, Gln, Glu |
| Asp | negatively charged R group | Asn, Gln, Glu |
| Cys | polar uncharged R group | Ala, Ser |
| Gln | polar uncharged R group | Asn, Asp, Glu |
| Glu | negatively charged R group | Asn, Asp, Gln |
| Gly | nonpolar aliphatic R group | Ala, Ser |
| His | positively charged R group | Arg, Tyr, Trp |
| Ile | nonpolar aliphatic R group | Leu, Met, Val |
| Leu | nonpolar aliphatic R group | Ile, Met, Val |
| Lys | positively charged R group | Arg, His |
| Met | nonpolar aliphatic R group | Ile, Leu, Phe, Val |
| Pro | polar uncharged R group | |
| Phe | nonpolar aromatic R group | Met, Trp, Tyr |
| Ser | polar uncharged R group | Ala, Gly, Thr |
| Thr | polar uncharged R group | Ala, Asn, Ser |
| Trp | nonpolar aromatic R group | His, Phe, Tyr, Met |
| Tyr | nonpolar aromatic R group | His, Phe, Trp |
| Val | nonpolar aliphatic R group | Ile, Leu, Met, Thr |

Amino acid substitutions in the amino acid sequence of a polypeptide to produce a recombinant polypeptide (e.g., AAE, PKS, PKC, PT, or TS enzyme) variant having a desired property and/or activity can be made by alteration of the coding sequence of the polypeptide (e.g., AAE, PKS, PKC, PT, or TS enzyme). Similarly, conservative amino acid substitutions in the amino acid sequence of a polypeptide to produce functionally equivalent variants of the polypeptide typically are made by alteration of the coding sequence of the recombinant polypeptide (e.g., AAE, PKS, PKC, PT, or TS enzyme).

Mutations (e.g, substitutions, insertions, additions, or deletions) can be made in a nucleic acid sequence by a variety of methods known to one of ordinary skill in the art. For example, mutations (e.g, substitutions, insertions, additions, or deletions) can be made by PCR-directed mutation, site-directed mutagenesis according to the method of Kunkel (Kunkel, *Proc. Nat. Acad. Set. U.S.A.* 82: 488-492, 1985), by chemical synthesis of a gene encoding a polypeptide, by CRISPR, or by insertions, such as insertion of a tag (e.g., a HIS tag or a GFP tag). Mutations can include, for example, substitutions, insertions, additions, deletions, and translocations, generated by any method known in the art. Methods for producing mutations may be found in in references such as Molecular Cloning: A Laboratory Manual, J. Sambrook, et al., eds., Fourth Edition, Cold Spring Harbor Laboratory Press, Cold Spring Harbor, N.Y., 2012, or Current Protocols in Molecular Biology, F. M. Ausubel, et al., eds., John Wiley & Sons, Inc., New York, 2010.

In some embodiments, methods for producing variants include circular permutation (Yu and Lutz, *Trends Biotechnol.* 2011 January; 29(1): 18-25). In circular permutation, the linear primary sequence of a polypeptide can be circularized (e.g., by joining the N-terminal and C-terminal ends of the sequence) and the polypeptide can be severed ("broken") at a different location. Thus, the linear primary sequence of the new polypeptide may have low sequence identity (e.g., less than 80%, less than 75%, less than 70%, less than 65%, less than 60%, less than 55%, less than 50%, less than 45%, less than 40%, less than 35%, less than 30%, less than 25%, less than 20%, less than 15%, less than 10%, less or less than 5%, including all values in between) as determined by linear sequence alignment methods (e.g, Clustal Omega or BLAST). Topological analysis of the two proteins, however, may reveal that the tertiary structure of the two polypeptides is similar or dissimilar. Without being bound by a particular theory, a variant polypeptide created through circular permutation of a reference polypeptide and with a similar tertiary structure as the reference polypeptide can share similar functional characteristics (e.g, enzymatic activity, enzyme kinetics, substrate specificity or product specificity). In some instances, circular permutation may alter the secondary structure, tertiary structure or quaternary structure and produce an enzyme with different functional characteristics (e.g, increased or decreased enzymatic activity, different substrate specificity, or different product specificity). See, e.g., Yu and Lutz, *Trends Biotechnol.* 2011 January; 29(1): 18-25.

It should be appreciated that in a protein that has undergone circular permutation, the linear amino acid sequence of the protein would differ from a reference protein that has not undergone circular permutation. However, one of ordinary skill in the art would be able to determine which residues in the protein that has undergone circular permutation correspond to residues in the reference protein that has not undergone circular permutation by, for example, aligning the sequences and detecting conserved motifs, and/or by comparing the structures or predicted structures of the proteins, e.g., by homology modeling.

In some embodiments, an algorithm that determines the percent identity between a sequence of interest and a reference sequence described in this application accounts for the presence of circular permutation between the sequences. The presence of circular permutation may be detected using any method known in the art, including, for example, RASPODOM (Weiner et al., Bioinformatics. 2005 Apr. 1; 21(7):932-7). In some embodiments, the presence of circulation permutation is corrected for (e.g., the domains in at least one sequence are rearranged) prior to calculation of the percent identity between a sequence of interest and a sequence described in this application. The claims of this application should be understood to encompass sequences for which percent identity to a reference sequence is calculated after taking into account potential circular permutation of the sequence.

Expression of Nucleic Acids in Host Cells

Aspects of the present disclosure relate to recombinant enzymes, functional modifications and variants thereof, as well as their uses. For example, the methods described in this application may be used to produce cannabinoids and/or cannabinoid precursors. The methods may comprise using a host cell comprising an enzyme disclosed in this application, cell lysate, isolated enzymes, or any combination thereof. Methods comprising recombinant expression of genes encoding an enzyme disclosed in this application in a host cell are encompassed by the present disclosure. In vitro methods comprising reacting one or more cannabinoid precursors or cannabinoids in a reaction mixture with an enzyme disclosed in this application are also encompassed by the present disclosure. In some embodiments, the enzyme is a TS.

A nucleic acid encoding any of the recombinant polypeptides (e.g., AAE, PKS, PKC, PT, or TS enzyme) described in this application may be incorporated into any appropriate vector through any method known in the art. For example, the vector may be an expression vector, including but not limited to a viral vector (e.g, a lentiviral, retroviral, adenoviral, or adeno-associated viral vector), any vector suitable for transient expression, any vector suitable for constitutive expression, or any vector suitable for inducible expression (e.g., a galactose-inducible or doxycycline-inducible vector).

A vector encoding any of the recombinant polypeptides (e.g., AAE, PKS, PKC, PT, or TS enzyme) described in this application may be introduced into a suitable host cell using any method known in the art. Non-limiting examples of yeast transformation protocols are described in Gietz et al., Yeast transformation can be conducted by the LiAc/SS Carrier DNA/PEG method. *Methods Mol Biol.* 2006; 313: 107-20, which is hereby incorporated by reference in its entirety. Host cells may be cultured under any conditions suitable as would be understood by one of ordinary skill in the art. For example, any media, temperature, and incubation conditions known in the art may be used. For host cells carrying an inducible vector, cells may be cultured with an appropriate inducible agent to promote expression.

In some embodiments, a vector replicates autonomously in the cell. In some embodiments, a vector integrates into a chromosome within a cell. A vector can contain one or more endonuclease restriction sites that are cut by a restriction endonuclease to insert and ligate a nucleic acid containing a gene described in this application to produce a recombinant vector that is able to replicate in a cell. Vectors are typically composed of DNA, although RNA vectors are also available. Cloning vectors include, but are not limited to: plasmids, fosmids, phagemids, virus genomes and artificial chromosomes. As used in this application, the terms "expression vector" or "expression construct" refer to a nucleic acid construct, generated recombinantly or synthetically, with a series of specified nucleic acid elements that permit transcription of a particular nucleic acid in a host cell (e.g., microbe), such as a yeast cell. In some embodiments, the nucleic acid sequence of a gene described in this application is inserted into a cloning vector so that it is operably joined to regulatory sequences and, in some embodiments, expressed as an RNA transcript. In some embodiments, the vector contains one or more markers, such as a selectable marker as described in this application, to identify cells transformed or transfected with the recombinant vector. In some embodiments, a host cell has already been transformed with one or more vectors. In some embodiments, a host cell that has been transformed with one or more vectors is subsequently transformed with one or more vectors. In some embodiments, a host cell is transformed simultaneously with more than one vector. In some embodiments, the nucleic acid sequence of a gene described in this application is recoded. Recoding may increase production of the gene product by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100%, including all values in between) relative to a reference sequence that is not recoded.

In some embodiments, the nucleic acid encoding any of the proteins described in this application is under the control of regulatory sequences (e.g., enhancer sequences). In some embodiments, a nucleic acid is expressed under the control of a promoter. The promoter can be a native promoter, e.g., the promoter of the gene in its endogenous context, which provides normal regulation of expression of the gene. Alternatively, a promoter can be a promoter that is different from the native promoter of the gene, e.g, the promoter is different from the promoter of the gene in its endogenous context.

In some embodiments, the promoter is a eukaryotic promoter. Non-limiting examples of eukaryotic promoters include TDH3, PGK1, PKC1, PDC1, TEF1, TEF2, RPL18B, SSA1, TDH2, PYK1, TPI1, GAL1, GAL10, GAL7, GAL3, GAL2, MET3, MET25, HXT3, HXT7, ACT1, ADH1, ADH2, CUP1-1, ENO2, and SOD1, as would be known to one of ordinary skill in the art (see, e.g., Addgene website: blog.addgene.org/plasmids-101-the-promoter-region). In some embodiments, the promoter is a prokaryotic promoter (e.g., bacteriophage or bacterial promoter). Non-limiting examples of bacteriophage promoters include Pls1con, T3, T7, SP6, and PL. Non-limiting examples of bacterial promoters include Pbad, PmgrB, Ptrc2, Plac/ara, Ptac, and Pm.

In some embodiments, the promoter is an inducible promoter. As used in this application, an "inducible promoter" is a promoter controlled by the presence or absence of a molecule. This may be used, for example, to controllably induce the expression of an enzyme. In some embodiments, an inducible promoter linked to a PT and/or a TS may be used to regulate expression of the enzyme(s), for example to reduce cannabinoid production in certain scenarios (e.g., during transport of the genetically modified organism to satisfy regulatory restrictions in certain jurisdictions, or between jurisdictions where cannabinoids may not be shipped). In some embodiments, an inducible promoter linked to a CBGAS and/or a TS, the CBGAS and/or TS may be used to regulate expression of the enzyme(s), for example to reduce cannabinoid production in certain scenarios (e.g., during transport of the genetically modified organism to satisfy regulatory restrictions in certain jurisdictions, or between jurisdictions where cannabinoids may not be shipped). Non-limiting examples of inducible promoters include chemically regulated promoters and physically regulated promoters. For chemically regulated promoters, the transcriptional activity can be regulated by one or more compounds, such as alcohol, tetracycline, galactose, a steroid, a metal, an amino acid, or other compounds. For physically regulated promoters, transcriptional activity can be regulated by a phenomenon such as light or temperature. Non-limiting examples of tetracycline-regulated promoters include anhydrotetracycline (aTc)-responsive promoters and other tetracycline-responsive promoter systems (e.g., a tetracycline repressor protein (tetR), a tetracycline operator sequence (tetO) and a tetracycline transactivator fusion protein (tTA)). Non-limiting examples of steroid-regulated promoters include promoters based on the rat glucocorticoid receptor, human estrogen receptor, moth ecdysone receptors, and promoters from the steroid/retinoid/thyroid receptor superfamily. Non-limiting examples of metal-regulated promoters include promoters derived from metallothionein (proteins that bind and sequester metal ions) genes. Non-limiting examples of pathogenesis-regulated promoters include promoters induced by salicylic acid, ethylene or benzothiadiazole (BTH). Non-limiting examples of temperature/heat-inducible promoters include heat shock promoters. Non-limiting examples of light-regulated promoters include light responsive promoters from plant cells. In certain embodiments, the inducible promoter is a galactose-inducible promoter. In some embodiments, the inducible promoter is induced by one or more physiological conditions (e.g, pH, temperature, radiation, osmotic pressure, saline gradients, cell surface binding, or concentration of one or more extrinsic or intrinsic inducing agents). Non-limiting examples of an extrinsic inducer or inducing agent include amino acids and amino acid analogs, saccharides and polysaccharides, nucleic acids, protein transcriptional activators and repressors, cytokines, toxins, petroleum-based compounds, metal containing compounds, salts, ions, enzyme substrate analogs, hormones or any combination.

In some embodiments, the promoter is a constitutive promoter. As used in this application, a "constitutive promoter" refers to an unregulated promoter that allows continuous transcription of a gene. Non-limiting examples of a constitutive promoter include TDH3, PGK1, PKC1, PDC1, TEF1, TEF2, RPL18B, SSA1, TDH2, PYK1, TPI1, HXT3, HXT7, ACT1, ADH1, ADH2, ENO2, and SOD1.

Other inducible promoters or constitutive promoters, including synthetic promoters, that may be known to one of ordinary skill in the art are also contemplated.

The precise nature of the regulatory sequences needed for gene expression may vary between species or cell types, but generally include, as necessary, 5' non-transcribed and 5' non-translated sequences involved with the initiation of transcription and translation respectively, such as a TATA box, capping sequence, CAAT sequence, and the like. In particular, such 5' non-transcribed regulatory sequences will include a promoter region which includes a promoter sequence for transcriptional control of the operably joined gene. Regulatory sequences may also include enhancer sequences or upstream activator sequences. The vectors disclosed may include 5' leader or signal sequences. The regulatory sequence may also include a terminator sequence. In some embodiments, a terminator sequence marks the end of a gene in DNA during transcription. The choice and design of one or more appropriate vectors suitable for inducing expression of one or more genes described in this application in a heterologous organism is within the ability and discretion of one of ordinary skill in the art.

Expression vectors containing the necessary elements for expression are commercially available and known to one of ordinary skill in the art (see, e.g., Sambrook et al., Molecular Cloning: A Laboratory Manual, Fourth Edition, Cold Spring Harbor Laboratory Press, 2012).

Host Cells

The disclosed cannabinoid biosynthetic methods and host cells are exemplified with *S. cerevisiae*, but are also applicable to other host cells, as would be understood by one of ordinary skill in the art.

Suitable host cells include, but are not limited to: yeast cells, bacterial cells, algal cells, plant cells, fungal cells, insect cells, and animal cells, including mammalian cells. In one illustrative embodiment, suitable host cells include is *E. coli* (e.g., Shuffle™ competent *E. coli* available from New England BioLabs in Ipswich, Mass.).

Other suitable host cells of the present disclosure include microorganisms of the genus *Corynebacterium*. In some embodiments, preferred *Corynebacterium* strains/species include: *C. efficiens*, with the deposited type strain being DSM44549, *C. glutamicum*, with the deposited type strain being ATCC13032, and *C. ammoniagenes*, with the deposited type strain being ATCC6871. In some embodiments the preferred host cell of the present disclosure is *C. glutamicum*.

Suitable host cells of the genus *Corynebacterium*, in particular of the species *Corynebacterium glutamicum*, are in particular the known wild-type strains: *Corynebacterium glutamicum* ATCC13032, *Corynebacterium acetoglutamicum* ATCC15806, *Corynebacterium acetoacidophilum* ATCC13870, *Corynebacterium melassecola* ATCC17965, *Corynebacterium thermoaminogenes* FERM BP-1539, *Brevibacterium flavum* ATCC14067, *Brevibacterium lactofermentum* ATCC13869, and *Brevibacterium divaricatum* ATCC14020; and L-amino acid-producing mutants, or strains, prepared therefrom, such as, for example, the L-lysine-producing strains: *Corynebacterium glutamicum* FERM-P 1709, *Brevibacterium flavum* FERM-P 1708, *Brevibacterium lactofermentum* FERM-P 1712, *Corynebacterium glutamicum* FERM-P 6463, *Corynebacterium glutamicum* FERM-P 6464, *Corynebacterium glutamicum* DM58-1, *Corynebacterium glutamicum* DG52-5, *Corynebacterium glutamicum* DSM5714, and *Corynebacterium glutamicum* DSM12866.

Suitable yeast host cells include, but are not limited to: *Candida*, *Hansenula*, *Saccharomyces*, *Schizosaccharomyces*, *Pichia*, *Kluyveromyces*, and *Yarrowia*. In some embodiments, the yeast cell is *Hansenula polymorpha*, *Saccharomyces cerevisiae*, *Saccaromyces carlsbergensis*, *Saccharomyces diastaticus*, *Saccharomyces norbensis*, *Saccharomyces kluyveri*, *Schizosaccharomyces pombe*, *Komagataella phaffii*, formerly known as *Pichia pastoris*, *Pichia finlandica*, *Pichia trehalophila*, *Pichia kodamae*, *Pichia membranaefaciens*, *Pichia opuntiae*, *Pichia thermotolerans*, *Pichia salictaria*, *Pichia quercuum*, *Pichia pijperi*, *Pichia stipitis*, *Pichia methanolica*, *Pichia angusta*, *Kluyveromyces lactis*, *Candida albicans*, or *Yarrowia lipolytica*.

In some embodiments, the yeast strain is an industrial polyploid yeast strain. Other non-limiting examples of fungal cells include cells obtained from *Aspergillus* spp., *Penicillium* spp., *Fusarium* spp., *Rhizopus* spp., *Acremonium* spp., *Neurospora* spp., *Sordaria* spp., *Magnaporthe* spp., *Allomyces* spp., *Ustilago* spp., *Botrytis* spp., and *Trichoderma* spp.

In certain embodiments, the host cell is an algal cell such as, *Chlamydomonas* (e.g., *C. Reinhardtii*) and *Phormidium* (*P.* sp. ATCC29409).

In other embodiments, the host cell is a prokaryotic cell. Suitable prokaryotic cells include gram positive, gram negative, and gram-variable bacterial cells. The host cell may be a species of, but not limited to: *Agrobacterium*, *Alicyclobacillus*, *Anabaena*, *Anacystis*, *Acinetobacter*, *Acidothermus*, *Arthrobacter*, *Azobacter*, *Bacillus*, *Bifidobacterium*, *Brevibacterium*, *Butyrivibrio*, *Buchnera*, *Campestris*, *Camplyobacter*, *Clostridium*, *Corynebacterium*, *Chromatium*, *Coprococcus*, *Escherichia*, *Enterococcus*, *Enterobacter*, *Erwinia*, *Fusobacterium*, *Faecalibacterium*, *Francisella*, *Flavobacterium*, *Geobacillus*, *Haemophilus*, *Helicobacter*, *Klebsiella*, *Lactobacillus*, *Lactococcus*, *Ilyobacter*, *Micrococcus*, *Microbacterium*, *Mesorhizobium*, *Methylobacterium*, *Methylobacterium*, *Mycobacterium*, *Neisseria*, *Pantoea*, *Pseudomonas*, *Prochlorococcus*, *Rhodobacter*, *Rhodopseudomonas*, *Rhodopseudomonas*, *Roseburia*, *Rhodospirillum*, *Rhodococcus*, *Scenedesmus*, *Streptomyces*, *Streptococcus*, *Synecoccus*, *Saccharomonospora*, *Saccharopolyspora*, *Staphylococcus*, *Serratia*, *Salmonella*, *Shigella*, *Thermoanaerobacterium*, *Tropheryma*, *Tularensis*, *Temecula*, *Thermosynechococcus*, *Thermococcus*, *Ureaplasma*, *Xanthomonas*, *Xylella*, *Yersinia*, and *Zymomonas*.

In some embodiments, the bacterial host strain is an industrial strain. Numerous bacterial industrial strains are known and suitable for the methods and compositions described in this application.

In some embodiments, the bacterial host cell is of the *Agrobacterium* species (e.g., *A. radiobacter*, *A. rhizogenes*, *A. rubi*), the *Arthrobacter* species (e.g., *A. aurescens*, *A. citreus*, *A. globformis*, *A. hydrocarboglutamicus*, *A. mysorens*, *A. nicotianae*, *A. paraffineus*, *A. protophonniae*, *A. roseoparaffinus*, *A. sulfureus*, *A. ureafaciens*), the *Bacillus* species (e.g., *B. thuringiensis*, *B. anthracis*, *B. megaterium*, *B. subtilis*, *B. lentus*, *B. circulars*, *B. pumilus*, *B. lautus*, *B. coagulans*, *B. brevis*, *B. firmus*, *B. alkaophius*, *B. licheniformis*, *B. clausii*, *B. stearothermophilus*, *B. halodurans* and *B. amyloliquefaciens*. In particular embodiments, the host cell will be an industrial *Bacillus* strain including but not limited to *B. subtilis*, *B. pumilus*, *B. licheniformis*, *B. megaterium*, *B. clausii*, *B. stearothermophilus* and *B. amyloliquefaciens*. In some embodiments, the host cell will be an industrial *Clostridium* species (e.g., *C. acetobutylicum*, *C. tetani* E88, *C. lituseburense*, *C. saccharobutylicum*, *C. perfringens*, *C. beijerinckii*). In some embodiments, the host cell will be an industrial *Corynebacterium* species (e.g., *C. glutamicum*, *C. acetoacidophilum*). In some embodiments, the host cell will be an industrial *Escherichia* species (e.g., *E. coli*). In some embodiments, the host cell will be an industrial *Erwinia* species (e.g., *E. uredovora*, *E. carotovora*, *E. ananas*, *E. herbicola*, *E. punctata*, *E. terreus*). In some embodiments, the host cell will be an industrial *Pantoea* species (e.g., *P. citrea*, *P. agglomerans*). In some embodiments, the host cell will be an industrial *Pseudomonas* species, (e.g., *P. putida*, *P. aeruginosa*, *P. mevalonii*). In some embodiments, the host cell will be an industrial *Streptococcus* species (e.g., *S. equisimiles*, *S. pyogenes*, *S. uberis*). In some embodiments, the host cell will be an industrial *Streptomyces* species (e.g., *S. ambofaciens*, *S. achromogenes*, *S. avermitilis*, *S. coelicolor*, *S. aureofaciens*, *S. aureus*, *S. fungicidicus*, *S. griseus*, *S. lividans*). In some embodiments, the host cell will be an industrial *Zymomonas* species (e.g., *Z. mobilis*, *Z. lipolytica*), and the like.

The present disclosure is also suitable for use with a variety of animal cell types, including mammalian cells, for example, human (including 293, HeLa, WI38, PER.C6 and Bowes melanoma cells), mouse (including 3T3, NS0, NS1, Sp2/0), hamster (CHO, BHK), monkey (COS, FRhL, Vero), insect cells, for example fall armyworm (including Sf9 and Sf21), silkmoth (including BmN), cabbage looper (including BTI-Tn-5B1-4) and common fruit fly (including Schneider 2), and hybridoma cell lines.

In various embodiments, strains that may be used in the practice of the disclosure including both prokaryotic and eukaryotic strains, and are readily accessible to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL). The present disclosure is also suitable for use with a variety of plant cell types. In some embodiments, the plant is of the *Cannabis* genus in the family Cannabaceae. In certain embodiments, the plant is of the species *Cannabis sativa, Cannabis indica*, or *Cannabis ruderalis*. In other embodiments, the plant is of the genus *Nicotiana* in the family Solanaceae. In certain embodiments, the plant is of the species *Nicotiana rustica.*

The term "cell," as used in this application, may refer to a single cell or a population of cells, such as a population of cells belonging to the same cell line or strain. Use of the singular term "cell" should not be construed to refer explicitly to a single cell rather than a population of cells. The host cell may comprise genetic modifications relative to a wild-type counterpart. Reduction of gene expression and/or gene inactivation in a host cell may be achieved through any suitable method, including but not limited to, deletion of the gene, introduction of a point mutation into the gene, selective editing of the gene and/or truncation of the gene. For example, polymerase chain reaction (PCR)-based methods may be used (see, e.g, Gardner el al., *Methods Mol Biol.* 2014; 1205:45-78). As a non-limiting example, genes may be deleted through gene replacement (e.g, with a marker, including a selection marker). A gene may also be truncated through the use of a transposon system (see, e.g., Poussu et al., *Nucleic Acids Res.* 2005; 33(12): e104). A gene may also be edited through of the use of gene editing technologies known in the art, such as CRISPR-based technologies.

Culturing of Host Cells

Any of the cells disclosed in this application can be cultured in media of any type (rich or minimal) and any composition prior to, during, and/or after contact and/or integration of a nucleic acid. The conditions of the culture or culturing process can be optimized through routine experimentation as would be understood by one of ordinary skill in the art. In some embodiments, the selected media is supplemented with various components. In some embodiments, the concentration and amount of a supplemental component is optimized. In some embodiments, other aspects of the media and growth conditions (e.g., pH, temperature, etc.) are optimized through routine experimentation. In some embodiments, the frequency that the media is supplemented with one or more supplemental components, and the amount of time that the cell is cultured, is optimized.

Culturing of the cells described in this application can be performed in culture vessels known and used in the art. In some embodiments, an aerated reaction vessel (e.g., a stirred tank reactor) is used to culture the cells. In some embodiments, a bioreactor or fermentor is used to culture the cell. Thus, in some embodiments, the cells are used in fermentation. As used in this application, the terms "bioreactor" and "fermentor" are interchangeably used and refer to an enclosure, or partial enclosure, in which a biological, biochemical and/or chemical reaction takes place that involves a living organism or part of a living organism. A "large-scale bioreactor" or "industrial-scale bioreactor" is a bioreactor that is used to generate a product on a commercial or quasi-commercial scale. Large scale bioreactors typically have volumes in the range of liters, hundreds of liters, thousands of liters, or more.

Non-limiting examples of bioreactors include: stirred tank fermentors, bioreactors agitated by rotating mixing devices, chemostats, bioreactors agitated by shaking devices, airlift fermentors, packed-bed reactors, fixed-bed reactors, fluidized bed bioreactors, bioreactors employing wave induced agitation, centrifugal bioreactors, roller bottles, and hollow fiber bioreactors, roller apparatuses (for example benchtop, cart-mounted, and/or automated varieties), vertically-stacked plates, spinner flasks, stirring or rocking flasks, shaken multi-well plates, MD bottles, T-flasks, Roux bottles, multiple-surface tissue culture propagators, modified fermentors, and coated beads (e.g., beads coated with serum proteins, nitrocellulose, or carboxymethyl cellulose to prevent cell attachment).

In some embodiments, the bioreactor includes a cell culture system where the cell (e.g., yeast cell) is in contact with moving liquids and/or gas bubbles. In some embodiments, the cell or cell culture is grown in suspension. In other embodiments, the cell or cell culture is attached to a solid phase carrier. Non-limiting examples of a carrier system includes microcarriers (e.g., polymer spheres, microbeads, and microdisks that can be porous or non-porous), cross-linked beads (e.g, dextran) charged with specific chemical groups (e.g, tertiary amine groups), 2D microcarriers including cells trapped in nonporous polymer fibers, 3D carriers (e.g., carrier fibers, hollow fibers, multi cartridge reactors, and semi-permeable membranes that can comprising porous fibers), microcarriers having reduced ion exchange capacity, encapsulation cells, capillaries, and aggregates. In some embodiments, carriers are fabricated from materials such as dextran, gelatin, glass, or cellulose.

In some embodiments, industrial-scale processes are operated in continuous, semi-continuous or non-continuous modes. Non-limiting examples of operation modes are batch, fed batch, extended batch, repetitive batch, draw/fill, rotating-wall, spinning flask, and/or perfusion mode of operation. In some embodiments, a bioreactor allows continuous or semi-continuous replenishment of the substrate stock, for example a carbohydrate source and/or continuous or semi-continuous separation of the product, from the bioreactor.

In some embodiments, the bioreactor or fermentor includes a sensor and/or a control system to measure and/or adjust reaction parameters. Non-limiting examples of reaction parameters include biological parameters (e.g., growth rate, cell size, cell number, cell density, cell type, or cell state, etc.), chemical parameters (e.g, pH, redox-potential, concentration of reaction substrate and/or product, concentration of dissolved gases, such as oxygen concentration and $CO_2$ concentration, nutrient concentrations, metabolite concentrations, concentration of an oligopeptide, concentration of an amino acid, concentration of a vitamin, concentration of a hormone, concentration of an additive, serum concentration, ionic strength, concentration of an ion, relative humidity, molarity, osmolarity, concentration of other chemicals, for example buffering agents, adjuvants, or reaction by-products), physical/mechanical parameters (e.g., density, conductivity, degree of agitation, pressure, and flow rate, shear stress, shear rate, viscosity, color, turbidity, light absorption, mixing rate, conversion rate, as well as thermodynamic parameters, such as temperature, light intensity/quality, etc.). Sensors to measure the parameters described in this application are well known to one of ordinary skill in the relevant mechanical and electronic arts. Control systems to adjust the parameters in a bioreactor based on the inputs from a sensor described in this application are well known to one of ordinary skill in the art in bioreactor engineering.

In some embodiments, the method involves batch fermentation (e.g., shake flask fermentation). General considerations for batch fermentation (e.g, shake flask fermentation) include the level of oxygen and glucose. For example, batch fermentation (e.g, shake flask fermentation) may be oxygen and glucose limited, so in some embodiments, the capability of a strain to perform in a well-designed fed-batch fermentation is underestimated. Also, the final product (e.g, cannabinoid or cannabinoid precursor) may display some differences from the substrate in terms of solubility, toxicity, cellular accumulation and secretion and in some embodiments can have different fermentation kinetics.

In some embodiments, the cells of the present disclosure are adapted to produce cannabinoids or cannabinoid precursors in vivo. In some embodiments, the cells are adapted to secrete one or more enzymes for cannabinoid synthesis (e.g., AAE, PKS, PKC, PT, or TS). In some embodiments, the cells of the present disclosure are lysed, and the remaining lysates are recovered for subsequent use. In such embodiments, the secreted or lysed enzyme can catalyze reactions for the production of a cannabinoid or precursor by bioconversion in an in vitro or ex vivo process. In some embodiments, any and all conversions described in this application can be conducted chemically or enzymatically, in vitro or in vivo.

Purification and Further Processing

In some embodiments, any of the methods described in this application may include isolation and/or purification of the cannabinoids and/or cannabinoid precursors produced (e.g., produced in a bioreactor). For example, the isolation and/or purification can involve one or more of cell lysis, centrifugation, extraction, column chromatography, distillation, crystallization, and lyophilization.

The methods described in this application encompass production of any cannabinoid or cannabinoid precursor known in the art. Cannabinoids or cannabinoid precursors produced by any of the recombinant cells disclosed in this application or any of the in vitro methods described in this application may be identified and extracted using any method known in the art. Mass spectrometry (e.g., LC-MS, GC-MS) is a non-limiting example of a method for identification and may be used to extract a compound of interest.

In some embodiments, any of the methods described in this application further comprise decarboxylation of a cannabinoid or cannabinoid precursor. As a non-limiting example, the acid form of a cannabinoid or cannabinoid precursor may be heated (e.g, at least 90° C.) to decarboxylate the cannabinoid or cannabinoid precursor. See, e,g, U.S. Pat. Nos. 10,159,908, 10,143,706, 9,908,832 and 7,344,736. See also, e,g, Wang et al., Cannabis Cannabinoid Res. 2016; 1(1): 262-271.

Compositions, Kits, and Administration

The present disclosure provides compositions, including pharmaceutical compositions, comprising a cannabinoid or a cannabinoid precursor, or pharmaceutically acceptable salt thereof, produced by any of the methods described in this application, and optionally a pharmaceutically acceptable excipient.

In certain embodiments, a cannabinoid or cannabinoid precursor described in this application is provided in an effective amount in a composition, such as a pharmaceutical composition. In certain embodiments, the effective amount is a therapeutically effective amount. In certain embodiments, the effective amount is a prophylactically effective amount.

Compositions, such as pharmaceutical compositions, described in this application can be prepared by any method known in the art. In general, such preparatory methods include bringing a compound described in this application (i.e., the "active ingredient") into association with a carrier or excipient, and/or one or more other accessory ingredients, and then, if necessary and/or desirable, shaping, and/or packaging the product into a desired single- or multi-dose unit.

Pharmaceutical compositions can be prepared, packaged, and/or sold in bulk, as a single unit dose, and/or as a plurality of single unit doses. A "unit dose" is a discrete amount of the pharmaceutical composition comprising a predetermined amount of the active ingredient. The amount of the active ingredient is generally equal to the dosage of the active ingredient which would be administered to a subject and/or a convenient fraction of such a dosage, such as one-half or one-third of such a dosage.

Relative amounts of the active ingredient, the pharmaceutically acceptable excipient, and/or any additional ingredients in a pharmaceutical composition described in this application will vary, depending upon the identity, size, and/or condition of the subject treated and further depending upon the route by which the composition is to be administered. The composition may comprise between 0.1% and 100% (w/w) active ingredient.

Pharmaceutically acceptable excipients used in the manufacture of pharmaceutical compositions include inert diluents, dispersing and/or granulating agents, surface active agents and/or emulsifiers, disintegrating agents, binding agents, preservatives, buffering agents, lubricating agents, and/or oils. Excipients such as cocoa butter and suppository waxes, coloring agents, coating agents, sweetening, flavoring, and perfuming agents may also be present in the composition. Exemplary excipients include diluents, dispersing and/or granulating agents, surface active agents and/or emulsifiers, disintegrating agents, binding agents, preservatives, buffering agents, lubricating agents, and/or oils (e.g., synthetic oils, semi-synthetic oils) as disclosed in this application.

Exemplary diluents include calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, and mixtures thereof.

Exemplary granulating and/or dispersing agents include potato starch, corn starch, tapioca starch, sodium starch glycolate, clays, alginic acid, guar gum, citrus pulp, agar, bentonite, cellulose, and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (Veegum), sodium lauryl sulfate, quaternary ammonium compounds, and mixtures thereof.

Exemplary surface active agents and/or emulsifiers include natural emulsifiers (e.g., acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g., bentonite (aluminum silicate) and Veegum (magnesium aluminum silicate)), long chain amino acid derivatives, high molecular weight alcohols (e.g, stearyl alcohol, cetyl alcohol, oleyl alcohol, triacetin monostearate, ethylene glycol distearate, glyceryl monostearate, and propylene glycol monostearate, polyvinyl alcohol), carbomers (e.g, carboxy polymethylene, polyacrylic acid, acrylic acid polymer, and carboxyvinyl polymer), carrageenan, cellulosic derivatives (e.g, carboxymethylcellulose sodium, powdered cellulose, hydroxymethyl cellulose, hydroxypropyl cellulose, hydroxypropyl methylcellulose, methylcellulose), sorbitan fatty acid esters (e.g., polyoxyethylene sorbitan monolaurate (Tween® 20), polyoxyethylene sorbitan (Tween® 60), polyoxyethylene sorbitan monooleate (Tween® 80), sorbitan monopalmitate (Span® 40), sorbitan monostearate (Span® 60), sorbitan tristearate (Span® 65), glyceryl monooleate, sorbitan monooleate (Span® 80), polyoxyethylene esters (e.g, polyoxyethylene monostearate (Myrj® 45), polyoxyethylene hydrogenated castor oil, polyethoxylated castor oil, polyoxymethylene stearate, and Solutol®), sucrose fatty acid esters, polyethylene glycol fatty acid esters (e.g, Cremophor®), polyoxyethylene ethers, (e.g, polyoxyethylene lauryl ether (Brij® 30)), poly(vinyl-pyrrolidone), diethylene glycol monolaurate, triethanolamine oleate, sodium oleate, potassium oleate, ethyl oleate, oleic acid, ethyl laurate, sodium lauryl sulfate, Pluronic® F-68, poloxamer P-188, cetrimonium bromide, cetylpyridinium chloride, benzalkonium chloride, docusate sodium, and/or mixtures thereof.

Exemplary binding agents include starch (e.g., cornstarch and starch paste), gelatin, sugars (e.g., sucrose, glucose, dextrose, dextrin, molasses, lactose, lactitol, mannitol, etc.), natural and synthetic gums (e.g, acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (Veegum®), and larch arabogalactan), alginates, polyethylene oxide, polyethylene glycol, inorganic calcium salts, silicic acid, polymethacrylates, waxes, water, alcohol, and/or mixtures thereof.

Exemplary preservatives include antioxidants, chelating agents, antimicrobial preservatives, antifungal preservatives, antiprotozoan preservatives, alcohol preservatives, acidic preservatives, and other preservatives. In certain embodiments, the preservative is an antioxidant. In other embodiments, the preservative is a chelating agent.

Exemplary antioxidants include alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and sodium sulfite.

Exemplary chelating agents include ethylenediaminetetraacetic acid (EDTA) and salts and hydrates thereof (e.g., sodium edetate, disodium edetate, trisodium edetate, calcium disodium edetate, dipotassium edetate, and the like), citric acid and salts and hydrates thereof (e.g, citric acid monohydrate), fumaric acid and salts and hydrates thereof, malic acid and salts and hydrates thereof, phosphoric acid and salts and hydrates thereof, and tartaric acid and salts and hydrates thereof. Exemplary antimicrobial preservatives include benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and thimerosal.

Exemplary antifungal preservatives include butyl paraben, methyl paraben, ethyl paraben, propyl paraben, benzoic acid, hydroxybenzoic acid, potassium benzoate, potassium sorbate, sodium benzoate, sodium propionate, and sorbic acid.

Exemplary alcohol preservatives include ethanol, polyethylene glycol, phenol, phenolic compounds, bisphenol, chlorobutanol, hydroxybenzoate, and phenylethyl alcohol.

Exemplary acidic preservatives include vitamin A, vitamin C, vitamin E, beta-carotene, citric acid, acetic acid, dehydroacetic acid, ascorbic acid, sorbic acid, and phytic acid.

Other preservatives include tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, Glydant® Plus, Phenonip®, methylparaben, Germall® 115, Germaben® II, Neolone®, Kathon®, and Euxyl®.

Exemplary buffering agents include citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, and mixtures thereof.

Exemplary lubricating agents include magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, and mixtures thereof.

Exemplary natural oils include almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, *litsea cubeba*, macadamia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary synthetic or semi-synthetic oils include, but are not limited to, butyl stearate, medium chain triglycerides (such as caprylic triglyceride and capric triglyceride), cyclomethicone, diethyl sebacate, dimethicone 360, isopropyl myristate, mineral oil, octyldodecanol, oleyl alcohol, silicone oil, and mixtures thereof. In certain embodiments, exemplary synthetic oils comprise medium chain triglycerides (such as caprylic triglyceride and capric triglyceride).

Liquid dosage forms for oral and parenteral administration include pharmaceutically acceptable emulsions, microemulsions, solutions, suspensions, syrups and elixirs. In addition to the active ingredients, the liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (e.g., cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, the oral compositions can include adjuvants such as wetting agents, emulsifying and suspending agents, sweetening, flavoring, and perfuming agents. In certain embodiments for parenteral administration, the conjugates described in this application are mixed with solubilizing agents such as Cremophor®, alcohols, oils, modified oils, glycols, polysorbates, cyclodextrins, polymers, and mixtures thereof.

Injectable preparations, for example, sterile injectable aqueous or oleaginous suspensions can be formulated according to the known art using suitable dispersing or wetting agents and suspending agents. The sterile injectable preparation can be a sterile injectable solution, suspension, or emulsion in a nontoxic parenterally acceptable diluent or solvent, for example, as a solution in 1,3-butanediol. Among the acceptable vehicles and solvents that can be employed are water, Ringer's solution, U.S.P., and isotonic sodium chloride solution. In addition, sterile, fixed oils are conventionally employed as a solvent or suspending medium. For this purpose, any bland fixed oil can be employed including synthetic mono- or di-glycerides. In addition, fatty acids such as oleic acid are used in the preparation of injectables.

The injectable formulations can be sterilized, for example, by filtration through a bacterial-retaining filter, or by incorporating sterilizing agents in the form of sterile solid compositions which can be dissolved or dispersed in sterile water or other sterile injectable medium prior to use.

In order to prolong the effect of a drug, it is often desirable to slow the absorption of the drug from subcutaneous or intramuscular injection. This can be accomplished by the use of a liquid suspension of crystalline or amorphous material with poor water solubility. The rate of absorption of the drug then depends upon its rate of dissolution, which, in turn, may depend upon crystal size and crystalline form. Alternatively, delayed absorption of a parenterally administered drug form may be accomplished by dissolving or suspending the drug in an oil vehicle.

Compositions for rectal or vaginal administration are typically suppositories which can be prepared by mixing the conjugates described in this application with suitable non-irritating excipients or carriers such as cocoa butter, polyethylene glycol, or a suppository wax which are solid at ambient temperature but liquid at body temperature and therefore melt in the rectum or vaginal cavity and release the active ingredient.

Solid dosage forms for oral administration include capsules, tablets, pills, powders, and granules. In such solid dosage forms, the active ingredient is mixed with at least one inert, pharmaceutically acceptable excipient or carrier such as sodium citrate or dicalcium phosphate and/or (a) fillers or extenders such as starches, lactose, sucrose, glucose, mannitol, and silicic acid, (b) binders such as, for example, carboxymethylcellulose, alginates, gelatin, polyvinylpyrrolidinone, sucrose, and acacia, (c) humectants such as glycerol, (d) disintegrating agents such as agar, calcium carbonate, potato or tapioca starch, alginic acid, certain silicates, and sodium carbonate, (e) solution retarding agents such as paraffin, (f) absorption accelerators such as quaternary ammonium compounds, (g) wetting agents such as, for example, cetyl alcohol and glycerol monostearate, (h) absorbents such as kaolin and bentonite clay, and (i) lubricants such as talc, calcium stearate, magnesium stearate, solid polyethylene glycols, sodium lauryl sulfate, and mixtures thereof. In the case of capsules, tablets, and pills, the dosage form may include a buffering agent.

Solid compositions of a similar type can be employed as fillers in soft and hard-filled gelatin capsules using such excipients as lactose or milk sugar as well as high molecular weight polyethylene glycols and the like. The solid dosage forms of tablets, dragees, capsules, pills, and granules can be prepared with coatings and shells such as enteric coatings and other coatings well known in the art of pharmacology. They may optionally comprise opacifying agents and can be of a composition that they release the active ingredient(s) only, or preferentially, in a certain part of the intestinal tract, optionally, in a delayed manner. Examples of encapsulating compositions which can be used include polymeric substances and waxes. Solid compositions of a similar type can be employed as fillers in soft and hard-filled gelatin capsules using such excipients as lactose or milk sugar as well as high molecular weight polethylene glycols and the like.

The active ingredient can be in a micro-encapsulated form with one or more excipients as noted above. The solid dosage forms of tablets, dragees, capsules, pills, and granules can be prepared with coatings and shells such as enteric coatings, release controlling coatings, and other coatings well known in the pharmaceutical formulating art. In such solid dosage forms the active ingredient can be admixed with at least one inert diluent such as sucrose, lactose, or starch. Such dosage forms may comprise, as is normal practice, additional substances other than inert diluents, e.g., tableting lubricants and other tableting aids such a magnesium stearate and microcrystalline cellulose. In the case of capsules, tablets and pills, the dosage forms may comprise buffering agents. They may optionally comprise opacifying agents and can be of a composition that they release the active ingredient(s) only, or preferentially, in a certain part of the intestinal tract, optionally, in a delayed manner. Examples of encapsulating agents which can be used include polymeric substances and waxes.

Dosage forms for topical and/or transdermal administration of a compound described in this application may include ointments, pastes, creams, lotions, gels, powders, solutions, sprays, inhalants, and/or patches. Generally, the active ingredient is admixed under sterile conditions with a pharmaceutically acceptable carrier or excipient and/or any needed preservatives and/or buffers as can be required. Additionally, the present disclosure contemplates the use of transdermal patches, which often have the added advantage of providing controlled delivery of an active ingredient to the body. Such dosage forms can be prepared, for example, by dissolving and/or dispensing the active ingredient in the proper medium. Alternatively or additionally, the rate can be controlled by either providing a rate controlling membrane and/or by dispersing the active ingredient in a polymer matrix and/or gel.

Suitable devices for use in delivering intradermal pharmaceutical compositions described in this application include short needle devices. Intradermal compositions can be administered by devices which limit the effective penetration length of a needle into the skin. Alternatively or additionally, conventional syringes can be used in the classical mantoux method of intradermal administration. Jet injection devices which deliver liquid formulations to the dermis via a liquid jet injector and/or via a needle which pierces the stratum corneum and produces a jet which reaches the dermis are suitable. Ballistic powder/particle delivery devices which use compressed gas to accelerate the compound in powder form through the outer layers of the skin to the dermis are suitable.

Formulations suitable for topical administration include, but are not limited to, liquid and/or semi-liquid preparations such as liniments, lotions, oil-in-water and/or water-in-oil emulsions such as creams, ointments, and/or pastes, and/or solutions and/or suspensions. Topically administrable formulations may, for example, comprise from about 1% to about 10% (w/w) active ingredient, although the concentration of the active ingredient can be as high as the solubility limit of the active ingredient in the solvent. Formulations for topical administration may further comprise one or more of the additional ingredients described in this application.

A pharmaceutical composition described in this application can be prepared, packaged, and/or sold in a formulation suitable for pulmonary administration via the buccal cavity. Such a formulation may comprise dry particles which comprise the active ingredient and which have a diameter in the range from about 0.5 to about 7 nanometers, or from about 1 to about 6 nanometers. Such compositions are conveniently in the form of dry powders for administration using a device comprising a dry powder reservoir to which a stream of propellant can be directed to disperse the powder and/or using a self-propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nanometers and at least 95% of the particles by number have a diameter less than 7 nanometers. Alternatively, at least 95% of the particles by weight have a diameter greater than 1 nanometer and at least 90% of the particles by number have a diameter less than 6 nanometers. Dry powder compositions may include a solid fine powder diluent such as sugar and are conveniently provided in a unit dose form.

Low boiling propellants generally include liquid propellants having a boiling point of below 65° F. at atmospheric pressure. Generally, the propellant may constitute 50 to 99.9% (w/w) of the composition, and the active ingredient may constitute 0.1 to 20% (w/w) of the composition. The propellant may further comprise additional ingredients such as a liquid non-ionic and/or solid anionic surfactant and/or a solid diluent (which may have a particle size of the same order as particles comprising the active ingredient).

Although the descriptions of pharmaceutical compositions provided in this application are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with ordinary experimentation.

Compounds provided in this application are typically formulated in dosage unit form for ease of administration and uniformity of dosage. It will be understood, however, that the total daily usage of the compositions described in this application will be decided by a physician within the scope of sound medical judgment. The specific therapeutically effective dose level for any particular subject or organism will depend upon a variety of factors including the disease being treated and the severity of the disorder; the activity of the specific active ingredient employed; the specific composition employed; the age, body weight, general health, sex, and diet of the subject; the time of administration, route of administration, and rate of excretion of the specific active ingredient employed; the duration of the treatment; drugs used in combination or coincidental with the specific active ingredient employed; and like factors well known in the medical arts.

The compounds and compositions provided in this application can be administered by any route, including enteral (e.g., oral), parenteral, intravenous, intramuscular, intraarterial, intramedullary, intrathecal, subcutaneous, intraventricular, transdermal, interdermal, rectal, intravaginal, intraperitoneal, topical (as by powders, ointments, creams, and/or drops), mucosal, nasal, bucal, sublingual; by intratracheal instillation, bronchial instillation, and/or inhalation; and/or as an oral spray, nasal spray, and/or aerosol. Specifically contemplated routes are oral administration, intravenous administration (e.g., systemic intravenous injection), regional administration via blood and/or lymph supply, and/or direct administration to an affected site. In general, the most appropriate route of administration will depend upon a variety of factors including the nature of the agent (e.g, its stability in the environment of the gastrointestinal tract), and/or the condition of the subject (e.g., whether the subject is able to tolerate oral administration).

In some embodiments, compounds or compositions disclosed in this application are formulated and/or administered in nanoparticles. Nanoparticles are particles in the nanoscale. In some embodiments, nanoparticles are less than 1 µm in diameter. In some embodiments, nanoparticles are between about 1 and 100 nm in diameter. Nanoparticles include organic nanoparticles, such as dendrimers, liposomes, or polymeric nanoparticles. Nanoparticles also include inorganic nanoparticles, such as fullerenes, quantum dots, and gold nanoparticles. Compositions may comprise an aggregate of nanoparticles. In some embodiments, the aggregate of nanoparticles is homogeneous, while in other embodiments the aggregate of nanoparticles is heterogeneous.

The exact amount of a compound required to achieve an effective amount will vary from subject to subject, depending, for example, on species, age, and general condition of a subject, severity of the side effects or disorder, identity of the particular compound, mode of administration, and the like. An effective amount may be included in a single dose (e.g., single oral dose) or multiple doses (e.g., multiple oral doses). In certain embodiments, when multiple doses are administered to a subject or applied to a tissue or cell, any two doses of the multiple doses include different or substantially the same amounts of a compound described in this application. In certain embodiments, when multiple doses are administered to a subject or applied to a tissue or cell, the frequency of administering the multiple doses to the subject or applying the multiple doses to the tissue or cell is three doses a day, two doses a day, one dose a day, one dose every other day, one dose every third day, one dose every week, one dose every two weeks, one dose every three weeks, or one dose every four weeks. In certain embodiments, the frequency of administering the multiple doses to the subject or applying the multiple doses to the tissue or cell is one dose per day. In certain embodiments, the frequency of administering the multiple doses to the subject or applying the multiple doses to the tissue or cell is two doses per day. In certain embodiments, the frequency of administering the multiple doses to the subject or applying the multiple doses to the tissue or cell is three doses per day. In certain embodiments, when multiple doses are administered to a subject or applied to a tissue or cell, the duration between the first dose and last dose of the multiple doses is one day, two days, four days, one week, two weeks, three weeks, one month, two months, three months, four months, six months, nine months, one year, two years, three years, four years, five years, seven years, ten years, fifteen years, twenty years, or the lifetime of the subject, tissue, or cell. In certain embodiments, the duration between the first dose and last dose of the multiple doses is three months, six months, or one year. In certain embodiments, the duration between the first dose and last dose of the multiple doses is the lifetime of the subject, tissue, or cell. In certain embodiments, a dose (e.g., a single dose, or any dose of multiple doses) described in this application includes independently between 0.1 μg and 1 μg, between 0.001 mg and 0.01 mg, between 0.01 mg and 0.1 mg, between 0.1 mg and 1 mg, between 1 mg and 3 mg, between 3 mg and 10 mg, between 10 mg and 30 mg, between 30 mg and 100 mg, between 100 mg and 300 mg, between 300 mg and 1,000 mg, or between 1 g and 10 g, inclusive, of a compound described in this application. In certain embodiments, a dose described in this application includes independently between 1 mg and 3 mg, inclusive, of a compound described in this application. In certain embodiments, a dose described in this application includes independently between 3 mg and 10 mg, inclusive, of a compound described in this application. In certain embodiments, a dose described in this application includes independently between 10 mg and 30 mg, inclusive, of a compound described in this application. In certain embodiments, a dose described in this application includes independently between 30 mg and 100 mg, inclusive, of a compound described in this application.

Dose ranges as described in this application provide guidance for the administration of provided pharmaceutical compositions to an adult. The amount to be administered to, for example, a child or an adolescent can be determined by a medical practitioner or person skilled in the art and can be lower or the same as that administered to an adult.

A compound or composition, as described in this application, can be administered in combination with one or more additional pharmaceutical agents (e.g., therapeutically and/or prophylactically active agents). The compounds or compositions can be administered in combination with additional pharmaceutical agents that improve their activity, improve bioavailability, improve safety, reduce drug resistance, reduce and/or modify metabolism, inhibit excretion, and/or modify distribution in a subject or cell. It will also be appreciated that the therapy employed may achieve a desired effect for the same disorder, and/or it may achieve different effects. In certain embodiments, a pharmaceutical composition described in this application including a compound described in this application and an additional pharmaceutical agent shows a synergistic effect that is absent in a pharmaceutical composition including one of the compound and the additional pharmaceutical agent, but not both.

The compound or composition can be administered concurrently with, prior to, or subsequent to one or more additional pharmaceutical agents, which may be useful as, e.g., combination therapies. Pharmaceutical agents include therapeutically active agents. Pharmaceutical agents also include prophylactically active agents. Pharmaceutical agents include small organic molecules such as drug compounds (e.g, compounds approved for human or veterinary use by the U.S. Food and Drug Administration as provided in the Code of Federal Regulations (CFR)), peptides, proteins, carbohydrates, monosaccharides, oligosaccharides, polysaccharides, nucleoproteins, mucoproteins, lipoproteins, synthetic polypeptides or proteins, small molecules linked to proteins, glycoproteins, steroids, nucleic acids, DNAs, RNAs, nucleotides, nucleosides, oligonucleotides, antisense oligonucleotides, lipids, hormones, vitamins, and cells. In certain embodiments, the additional pharmaceutical agent is a pharmaceutical agent useful for treating and/or preventing a disease (e.g., proliferative disease, neurological disease, painful condition, psychiatric disorder, or metabolic disorder). Each additional pharmaceutical agent may be administered at a dose and/or on a time schedule determined for that pharmaceutical agent. The additional pharmaceutical agents may also be administered together with each other and/or with the compound or composition described in this application in a single dose or administered separately in different doses. The particular combination to employ in a regimen will take into account compatibility of the compound described in this application with the additional pharmaceutical agent(s) and/or the desired therapeutic and/or prophylactic effect to be achieved. In general, it is expected that the additional pharmaceutical agent(s) in combination be utilized at levels that do not exceed the levels at which they are utilized individually. In some embodiments, the levels utilized in combination will be lower than those utilized individually.

In some embodiments, one or more of the compositions described in this application are administered to a subject. In certain embodiments, the subject is an animal. The animal may be of either sex and may be at any stage of development. In certain embodiments, the subject is a human. In other embodiments, the subject is a non-human animal. In certain embodiments, the subject is a mammal. In certain embodiments, the subject is a non-human mammal. In certain embodiments, the subject is a domesticated animal, such as a dog, cat, cow, pig, horse, sheep, or goat. In certain embodiments, the subject is a companion animal, such as a dog or cat. In certain embodiments, the subject is a livestock animal, such as a cow, pig, horse, sheep, or goat. In certain embodiments, the subject is a zoo animal. In another embodiment, the subject is a research animal, such as a rodent (e.g., mouse, rat), dog, pig, or non-human primate.

Also encompassed by the disclosure are kits (e.g., pharmaceutical packs). The kits provided may comprise a composition, such as a pharmaceutical composition, or a compound described in this application and a container (e.g, a vial, ampule, bottle, syringe, and/or dispenser package, or other suitable container). In some embodiments, provided kits may optionally further include a second container comprising a pharmaceutical excipient for dilution or suspension of a pharmaceutical composition or compound described in this application. In some embodiments, the pharmaceutical composition or compound described in this application provided in the first container and the second container a combined to form one unit dosage form.

Thus, in one aspect, provided are kits including a first container comprising a compound or composition described in this application. In certain embodiments, the kits are useful for treating a disease in a subject in need thereof. In certain embodiments, the kits are useful for preventing a disease in a subject in need thereof. In certain embodiments, the kits are useful for reducing the risk of developing a disease in a subject in need thereof.

In certain embodiments, a kit described in this application further includes instructions for using the kit. A kit described in this application may also include information as required by a regulatory agency such as the U.S. Food and Drug Administration (FDA). In certain embodiments, the information included in the kits is prescribing information. In certain embodiments, the kits and instructions provide for treating a disease in a subject in need thereof. In certain embodiments, the kits and instructions provide for preventing a disease in a subject in need thereof. In certain embodiments, the kits and instructions provide for reducing the risk of developing a disease in a subject in need thereof. A kit described in this application may include one or more additional pharmaceutical agents described in this application as a separate composition.

The present invention is further illustrated by the following Examples, which in no way should be construed as limiting. The entire contents of all of the references (including literature references, issued patents, published patent applications, and co-pending patent applications) cited throughout this application are hereby expressly incorporated by reference. If a reference incorporated in this application contains a term whose definition is incongruous or incompatible with the definition of same term as defined in the present disclosure, the meaning ascribed to the term in this disclosure shall govern. However, mention of any reference, article, publication, patent, patent publication, and patent application cited in this application is not, and should not be taken as an acknowledgment or any form of suggestion that they constitute valid prior art or form part of the common general knowledge in any country in the world.

EXAMPLES

Example 1: Functional Expression of AAE Genes in E. coli and S. cerevisiae

It was reported previously that S. cerevisiae has endogenous AAE activity that allows conversion of hexanoate to hexanoyl-CoA (Gagne et al. 2012). However, in some embodiments, the endogenous AAE activity of S. cerevisiae may be insufficient for industrial-scale synthesis of downstream products. This example validates novel genes with AAE activity that can be used in the cells, reactions, and methods of the present disclosure.

Several DNA sequences with predicted AAE functionality were identified from the genomes of the yeast Yarrowia lipolytica (Y. lipolytica) and the bacterium Rhodopseudomonas palustris (R. palustris). The predicted AAE genes were first codon-optimized in silico for expression in E. coli. The codon-optimized gene sequences were synthesized via standard DNA synthesis techniques and were expressed in recombinant E. coli host cells (FIG. 4). Lysates from the recombinant E. coli host cells were then tested for AAE activity using an assay described below.

FIG. 4 shows the results from the AAE activity assay in E. coli host cells. 3 out of 4 predicted Y. lipolytica AAEs (strains t49578, t49594, and t51477) and both of the predicted R. palustris AAEs (strains t55127 and t55128) exhibited activity on a hexanoate substrate. Strains t49594 and t51477 expressed the candidate AAE enzyme as a fusion protein with an N-terminal MYC tag. In addition, the assays also showed that 2 out of 4 predicted Y. lipolytica AAEs (strains t49594 and t51477) and both of the predicted R. palustris AAEs (strains t55127 and t55128) also demonstrated activity on a butyrate substrate.

The newly described AAEs were also found to be capable of exhibiting AAE activity in eukaryotes. Briefly, the Y. lipolytica AAE that produced the best results in E. coli host cells was selected. This corresponded to the AAE expressed by strain t49594 (which encodes a protein corresponding to the protein provided by Uniprot Accession No. Q6C577 with a N-terminal MYC tag). The gene encoding this AAE was codon-optimized for expression in S. cerevisiae, and the last three residues (peroxisomal targeting signal 1) were removed. Two different codon-optimized versions of this AAE were synthesized in the replicative yeast expression vector shown in FIGS. 5A-5B. The recoded sequences only shared 81.66% sequence identity at the DNA level, while encoding for the same polypeptide. Both AAE expression constructs were then transformed into a CEN.PK S. cerevisiae strain, and transformants were selected based on ability to grow on media lacking uracil. The transformants were tested for AAE activity with a colorimetric AAE assay (described below). An S. cerevisiae strain expressing GFP was used as a negative control (strain t390338).

The results from the colorimetric AAE assay are shown in FIG. 6. Both of the codon-optimized versions of the Y. lipolytica AAE (strains t392878 and t392879) exhibited AAE activity on a hexanoate substrate, demonstrating that the newly disclosed AAEs could also be used in eukaryotic hosts. These enzymes were thus demonstrated to be capable of catalyzing the first enzymatic step in microbial production of cannabinoids from carboxylic acids.

This Example demonstrates identification of AAEs that are capable of using hexanoate and butyrate as substrates to produce cannabinoid precursors. Detailed results for the AAE activity experiments in E. coli host cells are provided below in Table 3. Sequence information for strains described in this Example are provided in Table 4 at the end of the Examples section.

TABLE 3

Activity of AAE Enzymes on Hexanoate and Butyrate in E. Coli

| Strain (E. coli) | Average Activity on Hexanoate | Standard Deviation Activity on Hexanoate | Average Activity on Butyrate | Standard Deviation Activity on Butyrate |
| --- | --- | --- | --- | --- |
| t49568 (Negative control) | −0.0495 | 0.014849 | −0.0105 | 0.04879 |
| t49578 | 0.222 | 0.016971 | −0.0195 | 0.010607 |
| t49580 | −0.065 | 0.019799 | −0.055 | 0.007071 |
| t49594 | 0.458 | 0.005657 | 0.3895 | 0.000707 |
| t51477 | 0.347 | 0.005657 | 0.046 | 0.005657 |
| t55127 | 0.395 | 0.011314 | 0.1835 | 0.024749 |
| t55128 | 0.2495 | 0.012021 | 0.2205 | 0.012021 |

Materials and Methods

AAE Assay for E. coli

E. coli BL21 strains harboring a plasmid that contained AAE genes driven by a T7 promoter were inoculated from glycerol stocks into shake flasks with 25 mL LB and grown overnight at 37° C. with shaking at 250 RPM. The next day, strains were inoculated 1% (v/v) into LB and grown for 3-6 hours until an OD600 of ~0.6 was attained. They were then induced with 1 mM IPTG and incubated overnight at 23° C. with shaking at 250 RPM. The next day, the cultures were harvested and pelleted. Cell pellets were lysed with Bug-Buster™ reagent (5 mL per g wet pellet) at 18° C. and shaken at 250 RPM for 20 min. Lysates were centrifuged at 4° C. and 4000 RPM for 20 min. The soluble fractions of the lysates were taken for the enzyme assay. The enzyme assay mixture contained 5 mM substrate (sodium hexanoate or sodium butyrate), 3 mM ATP, 1 mM CoA, 5 mM $MgCl_2$, and 100 mM HEPES (pH 7.5). 25 µL of *E. coli* lysates were added to 500 µL of assay mixture and allowed to react at 30° C., 250 RPM for 20 min. Assays were then quenched by adding 50 µL of the reaction to 50 µL of 2 mM DTNB. Absorbance was measured at 412 nm to quantify the decrease in free CoA.

AAE Assay for *S. cerevisiae*

5 µL/well of thawed glycerol stocks were stamped into 300 µL/well of SC-URA+4% dextrose in half-height deep-well plates, which were sealed with AeraSeal™ film. Samples were incubated at 30° C. and shaken at 1000 RPM in 80% humidity for 2 days. 10 µL/well of resulting precultures were stamped into 300 µL/well of SC-URA+4% dextrose in half-height deepwell plates, which were sealed with AeraSeal™ film. Samples were incubated at 30° C. and shaken at 1000 RPM in 80% humidity for 3 days. 10 µL of resulting production cultures were stamped into 140 µL/well PBS in flat bottom plates. Optical measurements were taken on a plate reader, with absorbance measured at 600 nm and fluorescence at 528 nm with 485 mn excitation.

Production culture plates were centrifuged at 4000 RPM for 10 min. Supernatant was removed, and the plates of pellets were heat-sealed and frozen at −80° C.

Pellets were thawed and 200 µL Y-PER per well was added. Samples were agitated at room temperature for 20 minutes and then pelleted at 3500 RPM for 10 minutes. 50 µL of the clarified lysate was combined with 50 µL of feed buffer or CoA standard in clear bottom plates. Plates were then incubated at 30° C. and shaken at 1000 RPM in 80% humidity for 60 min. 1 µL of DTNB buffer was added to each well to a final concentration of 100 µM DTNB, and samples were agitated at room temperature for 15 minutes. Absorbance was measured at 412 nm to quantify the decrease in free CoA.

Materials included:
Feed Buffers:
  10 mM $MgCl_2$
  1 mM sodium hexanoate
  0.5 mM CoA
  1 mM ATP
  100 mM Tris HCl pH 7.6
DTNB Buffer:
  10 mM DTNB (Sigma D8130) (stock of DTNB in DMSO)
  100 mM Tris-HCl pH7.6 (Teknova)
Y-PER Yeast Protein Extraction Reagent (Thermo 78990):
  +1 tablet/50 mL complete, EDTA-free, protease inhibitors (Sigma, 11873580001)
Coenzyme A trilithium salt (Sigma C3019)

Example 2: Functional Expression of OLS Genes in *S. cerevisiae*

Functional expression of *C. saliva* olivetol synthase (OLS) and olivetolic acid cyclase (OAC) enzymes in *S. cerevisiae* was previously reported (Gagne et al. 2012). To identify other OLS genes that can be functionally expressed, a library of approximately 2000 OLS candidate genes was designed. The genes within the library were codon-optimized for expression in *S. cerevisiae* and synthesized in the replicative yeast expression vector shown in FIGS. 5A-5B.

Each candidate OLS was transformed into an auxotrophic *S. cerevisiae* CEN.PK GAL80 knockout strain, and transformants were selected based on ability to grow on media lacking uracil. The transformants were tested for olivetol and olivetolic acid production from sodium hexanoate in vivo in a high-throughput primary screen, as described in the materials and methods section below. Top olivetol and/or olivetolic acid-producing strains that were identified in the primary screen were subsequently tested in a secondary screen to verify and further quantify olivetol and olivetolic acid production.

Numerous yeast transformants were observed to be capable of producing olivetol in the primary screen (FIG. 8). In particular, two of the top olivetol-producing strains were strain t395094 and strain t393991 (FIG. 8). These two strains were also found to be among the top olivetol-producing strains in the secondary screen.

When the OLS library described in this Example was designed and screened in the primary and secondary screens, it was expected that the strains expressed full-length candidate OLS enzymes. Specifically, strain t395094 was believed to express a full-length OLS protein from *Araucaria cunninghamii* (Hoop pine) (corresponding to Uniprot Accession No. A0A0D6QTX3) and strain t393991 was believed to express a full-length OLS protein from Cymbidium hybrid cultivar (corresponding to Uniprot Accession No. A0A088G5Z5). However, as explained further in Table 5 at the end of the Examples section, sequencing analysis of strains from the OLS library used for these screens later revealed that there was a 6-nucleotide deletion in the sequences of many of the genes encoding the OLS enzymes in the library. Specifically, this deletion affected all of the candidate OLSs expressed by the strains identified in FIGS. 8-10, including the candidate OLSs expressed by strains t395094 and t393991 (Table 5).

The 6-nucleotide deletion included the first two nucleotides within the start codon of the genes encoding the OLS enzymes. As one of ordinary skill in the art would appreciate, such a deletion may result in the truncation of one or more amino acids from the N-terminus of the proteins encoded by the affected genes, and such a deletion could potentially extend to the next in-frame methionine residue in the intended protein sequence. For example, strain t393991 expressed a truncated version of a codon-optimized nucleic acid encoding an OLS protein from Cymbidium hybrid cultivar (Table 5). The full-length Cymbidium hybrid cultivar protein corresponds to SEQ ID NO: 7. If the deletion in the nucleic acid encoding this OLS protein were to result in translation commencing from the next start codon within the same reading frame, this would result in an N-terminally truncated version of the full-length OLS protein from Cymbidium hybrid cultivar. A protein sequence for a truncated protein that commences from the next start codon within the same reading frame is provided by SEQ ID NO: 714. SEQ ID NO: 714 has a truncation of the first 86 amino acids of SEQ ID NO: 7 and is approximately 77.9% identical to SEQ ID NO: 7.

Due to the truncation of OLS candidate genes within the library, candidate OLS genes screened in this Example were independently screened again using a new library that expressed only full-length OLS genes (Example 3). As discussed in Example 3, screening with a full-length OLS library independently identified both the OLS protein from *Araucaria cunninghamii* (Hoop pine) (corresponding to Uniprot Accession No. A0A0D6QTX3) and the OLS protein from Cymbidium hybrid cultivar (corresponding to Uniprot Accession No. A0A088G5Z5), discussed above, verifying the identification of these candidate OLSs as being highly effective for olivetol production in recombinant host cells.

It was determined that the OLS enzymes expressed by positive control strains t339579 and t339582, depicted in FIGS. 8-10, were also affected by the 6-nucleotide deletion discussed above. Accordingly, the low amounts of olivetol and olivetolic acid produced by the strains labelled as positive controls in FIGS. 8-10 may have been caused by disrupted expression of these proteins due to truncation.

Identification of Bifunctional PKS-PKC Enzymes

It was previously observed that *S. cerevisiae* possesses native OAC activity which enables some amount of the OLS product, 3,5,7-trioxododecanoyl-CoA, to be converted to olivetolic acid instead of undergoing a spontaneous decarboxylative cyclization to olivetol in the absence of OAC activity (FIG. 1). Most strains tested in the primary screen were observed to produce a constant (i.e., fixed) ratio of olivetolic acid to olivetol (FIG. 10). Without wishing to be bound by any theory, the accumulation of olivetolic acid and olivetol in these strains may be due to the reported endogenous *S. cerevisiae* OAC activity competing with spontaneous conversion of 3,5,7-trioxododecanoyl-CoA to olivetol. Both products, olivetol and olivetolic acid, increase proportionally with their shared precursor.

However, multiple strains were identified in the primary screen that demonstrated olivetolic acid production outside of the constant olivetolic acid to olivetol ratio discussed above. Strain t393974 demonstrated the highest olivetolic acid production (FIG. 9). In particular, strain t393974 was observed to produce substantially more olivetolic acid than olivetol in the primary screen—a quantity of olivetolic acid that was outside of the fixed ratio exhibited by other tested strains (FIG. 10). These data suggested that the OLS enzyme expressed by strain t393974 may be a bifunctional enzyme possessing both polyketide synthase and polyketide cyclase catalytic functions and may be capable of catalyzing both reactions R2 and R3 in FIG. 2, and, at least, both reactions R2a and R3a in FIG. 1 ("Bifunctional PKS-PKC").

As discussed above, when the OLS library described in this Example was designed and screened in the primary and secondary screens, it was expected that the strains expressed full-length candidate OLS enzymes. Specifically, strain t393974 was believed to express a full-length OLS protein from *Corchorus olitorius* (Jute) (corresponding to UniProt Accession No. A0A1R3HSU5). However, as discussed above and explained further in Table 5 at the end of the Examples section, sequencing analysis of strains from the OLS library used for these screens later revealed that there was a 6-nucleotide deletion in the sequences of many of the genes encoding the OLS enzymes in the library, which affected all of the candidate OLSs expressed by the strains identified in FIGS. 8-10, including the candidate OLS expressed by strain t393974 (Table 5). Accordingly, strain t393974 expressed a truncated version of a codon-optimized nucleic acid encoding an OLS protein from *Corchorus olitorius* (Jute) (Table 5). The full-length *Corchorus olitorius* (Jute) protein corresponds to SEQ ID NO: 6.

Due to the sequence truncation of OLS candidate genes within the library, candidate OLS genes screened in this Example were independently screened again using a new library that expressed only full-length OLS genes (Example 3). As discussed in Example 3, screening with a full-length OLS library also independently identified the candidate OLS protein from *Corchorus olitorius* (Jute) (corresponding to UniProt Accession No. A0A1R3HSU5; SEQ ID NO: 6) as an OLS that produced both olivetol and olivetolic acid.

Materials and Methods
OLS Assay

A library of approximately 2000 OLS enzymes was transformed into *S. cerevisiae*. 5 µL/well of thawed glycerol stocks were stamped into 300 µL/well of SC-URA+4% dextrose in half-height deepwell plates, which were sealed with AeraSeal™ films. Samples were incubated at 30° C. and shaken at 1000 RPM in 80% humidity for 2 days. 10 µL/well of the resulting precultures were stamped into 300 µL/well of SC-URA+4% Dextrose+1 mM sodium hexanoate in half-height deepwell plates, which were sealed with AeraSeal™ films. Samples were incubated at 30° C. and shaken at 1000 RPM in 80% humidity for 4 days. 10 µL/well of the resulting production cultures were stamped into 140 µL/well PBS in flat bottom plates. Optical measurements were taken on a plate reader, with absorbance measured at 600 nm and fluorescence at 528 nm with 485 mn excitation.

30 µL/well of production cultures were stamped into 270 µL/well of 100% methanol containing 300 µg/L 3-(3-Hydroxypropyl)phenol (3HPP) in half-height deepwell plates. Plates were heat sealed and frozen at −80° C. for two hours. Plates were then thawed for 30 minutes and spun down at 4° C. at 4000 rpm for 10 min. 75 µL of supernatant from each well of each plate was stamped into Corning 3694 (half area) plates, which were then submitted for LC-MS quantification of olivetol and olivetolic acid.

The experimental protocol for the secondary screen was the same as described above, except that four replicates per strain were tested and standard curves of both olivetol and olivetolic acid were prepared so that both products could be quantified.

Example 3: Generation and Screening of Full-Length OLS Library

As discussed in Example 2, sequencing analysis of strains from the OLS library used for the screening described in Example 2 revealed that many of the genes encoding the OLS enzymes in the library were inadvertently truncated N-terminally. This truncation affected all of the strains identified in FIGS. 8-10, including the positive control strains.

Accordingly, a new OLS library was generated to contain only OLS genes that produce full-length OLS enzymes. The full-length OLS library contained full-length versions of the approximately 2000 OLS enzymes from the original library described in Example 2 and also included approximately 900 additional candidate OLS enzymes. All candidate OLS enzymes were codon optimized for expression in *S. cerevisiae*. Strain t527340, comprising an OLS from *C. saliva*, was included in the library as a positive control, and strain t527338, comprising GFP, was included in the library as a negative control. A high-throughput primary screen was conducted with the full-length OLS library using the same OLS assay described in Example 2 with the following exceptions: all library members and controls were transformed into an auxotrophic CEN.PK strain that comprised a chromosomally integrated heterologous gene encoding AAE VcsA (Uniprot Accession Q6N4N8) from *R. palustris*; and neither sodium hexanoate nor sodium butyrate were included in the production cultures.

Top olivetol and/or olivetolic acid-producing strains from the high-throughput primary screen were carried over to a secondary screen to verify and further quantify olivetol production. The experimental protocol for the secondary screen was the same as the primary screen except that: four replicates per strain were tested; and one set of cultures was supplemented with 1 mM sodium hexanoate, while the second set of cultures was not supplemented with sodium hexanoate. Olivetol production was normalized to a positive control strain expressing a C. Sativa OLS. Table 7 provides results for strains that exhibited average normalized olivetol>1 and/or that produced higher amounts of olivetolic acid than the positive control in samples that were supplemented with sodium hexanoate. FIG. 12A depicts olivetol production in library strains supplemented with sodium hexanoate. FIG. 12B depicts olivetolic acid production in library strains supplemented with sodium hexanoate. Table 8 provides results for strains that exhibited average normalized olivetol>1 and/or that produced higher amounts of olivetolic acid than the positive control in samples that were not supplemented with sodium hexanoate. Table 6 provides sequence information for strains described in Tables 7 and 8. The Average Normalized Olivetol for each strain was calculated by taking the mean of the following ratio for each replicate of that strain: the ratio of olivetol to absorbance measured at 600 nm to average olivetol produced by the C. sativa OLS positive control in the same plate.

One of the top olivetol-producing strains identified in this Example was strain t527346, comprising an OLS enzyme from Cymbidium hybrid cultivar (Accession ID: A0A088G5Z5; SEQ ID NO: 7; Tables 6-8). As discussed above, this candidate OLS was also identified in the screening conducted in Example 2. Protein alignments conducted with BLASTP using default parameters identified two other OLS candidates that shared at least 90% identity with the OLS enzyme from Cymbidium hybrid cultivar (Accession ID: A0A088G5Z5; SEQ ID NO: 7). These strains were: strain t598916 (expressing an OLS corresponding to SEQ ID NO: 145) and strain t599231 (expressing an OLS corresponding to SEQ ID NO: 15) (Tables 6-8), which were 93.07% and 91.79%, identical to SEQ ID NO: 7, respectively.

Another notable olivetol-producing strain identified in this Example was strain t599285, comprising an OLS enzyme from *Araucaria cunninghamii* (Accession A0A0D6QTX3; SEQ ID NO: 17). As discussed above, this candidate OLS was also identified in the screening conducted in Example 2.

Consistent with the identification in Example 2 of a candidate OLS from *Corchorus olitorius* (Jute) as a potentially bifunctional OLS, strain t598084, comprising a full-length version of the *Corchorus olitorius* (Jute) OLS (corresponding to UniProt Accession No. A0A1R3HSU5; SEQ ID NO: 6) was independently identified in this Example as a candidate OLS that produced more olivetolic acid than a *Cannabis* OLS positive control, and produced more olivetolic acid than olivetol, based on average olivetol and olivetolic acid produced (Tables 6-8).

Example 4: Generation and Screening of C. sativa OLS Protein Engineering Library in S. cerevisiae To identify C. sativa OLS (CsOLS) enzyme variants with improved olivetol production, a library comprised of approximately 1300 members was designed. The library included CsOLS enzymes containing single or multiple amino acid substitutions or deletions. Nucleotide sequences were codon-optimized for expression in S. cerevisiae and synthesized in the replicative yeast expression vector shown in FIGS. 5A-5B. Each candidate enzyme expression construct was transformed into an auxotrophic S. cerevisiae CEN.PK GAL80 knockout strain. Transformants were selected based on ability to grow on media lacking uracil. Strain t346317, carrying GFP, was included in the library as a negative control.

The library of candidate CsOLS enzyme variants was assayed for activity in a high-throughput primary screen using the OLS assay described in Example 2 (FIG. 13). LC-MS analysis revealed that approximately 95% of library members produced measurable amounts of olivetol.

The top olivetol and/or olivetolic acid-producing strains from the primary screen were carried over to a secondary screen to verify the results. The experimental protocol for the secondary screen was the same as the primary screen, except that four replicates per strain were tested and a standard curve for olivetol and olivetolic acid was generated so that the amount of olivetol and olivetolic acid could be quantified via LC-MS (FIG. 13.)

Multiple OLS variants were identified that were capable of producing olivetol (Table 9). In order to investigate where the point mutations in the OLS variants were located relative to the OLS enzyme structure, a 3D model of the wildtype C. saliva OLS protein (corresponding to SEQ ID NO: 5) was generated using Rosetta protein modeling software. The active site of the C. sativa OLS enzyme was identified based on the catalytic triad of residues described in Taura et al. (2009) FEBS Letters for OLS enzymes, consisting of residues H297, C157, and N330 in the C. sativa OLS enzyme. The active site was also defined to include a docked molecule of hexanoyl-CoA (OLS substrate). Residues were considered to be within the active site if they were within about 12 angstroms of any of the residues within the catalytic triad of the OLS enzyme and/or within about 12 angstroms of a docked substrate within the OLS enzyme.

A subset of OLS point mutations was identified that included strains that produced at least 10 mg/L olivetol and mapped to within the active site. This group of point mutations included: T17K, I23C, L25R, K51R, D54R, F64Y, V95A, T123C, A125S, Y153G, E196K, L201C, I207L, L241I, T247A, M267K, M267G, I273V, L277M, T296A, V307I, D320A, V324I, S326R, H328Y, S334P, S334A, T335C, R375T (Table 9). FIG. 17 provides a schematic of the 3D structure of the C. Sativa OLS protein (corresponding to SEQ ID NO: 5), showing the catalytic triad, the bound hexanoyl-CoA substrate, and the cluster of point mutations identified within the active site.

OLS point mutations from strains that produced at least 10 mg/L olivetol and mapped to within about 8 angstroms of any of the residues within the catalytic triad of the OLS enzyme and/or within about 8 angstroms of a docked substrate within the OLS included: K51R, D54R, T123C, A125S, L201C, I207L, L241I, T247A, M267K, M267G, I273V, T296A, V307I, V324I, S326R, H328Y, S334P, T335C, and R375T. FIG. 16 provides a schematic of the 3D structure of the C. Sativa OLS protein (corresponding to SEQ ID NO: 5), showing the catalytic triad, the bound hexanoyl-CoA substrate, and the cluster of point mutations identified within about 8 angstroms of any of the residues within the catalytic triad of the OLS enzyme and/or within about 8 angstroms of a docked substrate within the PKS.

The point mutation that was found to be associated with the most olivetol production was a T335C mutation in the C. sativa OLS sequence (Table 9). This residue maps to the active site of the OLS enzyme (FIGS. 16-17). In further support of the importance of this residue for olivetol production, at least 5 of the high-producing olivetol candidate OLSs identified in Example 3 contain a C residue at this position (strain IDs t527346 (SEQ ID NO: 7), t598265 (SEQ ID NO: 13), t598301 (SEQ ID NO: 7), t598916 (SEQ ID NO: 145), t598976 (SEQ ID NO: 8), t599231 (SEQ ID NO: 15)). Strains t527346 and t598301 comprise an OLS that has the same amino acid sequence but the OLS is encoded by different nucleic acid sequences.

Additional *C. sativa* OLS variants were identified that did not map within the active site, but which were observed to produce more than approximately 13 mg/L olivetol (Table 9). This group of point mutations included: I284Y, K100L, K116R, I278E, K108D, L348S, K71R, V92G, T128V, K100M, Y135V, P229A, T128A, T128I (Table 9).

Table 13 provides sequence information for strains described in Table 9.

Thus, novel variants of the *C. sativa* OLS protein that may be useful for olivetol production in recombinant host cells were identified.

Example 5. Generation and Screening of *C. sativa* OLS (CsOLS), Cymbidium OLS (ChOLS), and *Corchorus* OLS (CoOLS) Protein Engineering Libraries in *S. cerevisiae*

An additional OLS protein engineering library was generated that included OLS variants based on three different OLS templates: *C. sativa* OLS (CsOLS); Cymbidium hybrid cultivar OLS (ChOLS) and *Corchorus olitorius* OLS (CoOLS), which were among the candidate OLSs identified in the screens described in Examples 2 and 3. As discussed above, ChOLS was identified as being one of the strongest olivetol-producing candidate OLS enzymes, while CoOLS was identified as being a potential bifunctional enzyme possessing both polyketide synthase and polyketide cyclase catalytic functions.

The library included approximately 300 variants of ChOLS and approximately 200 variants of CoOLS. Variants of ChOLS and CoOLS included both single and multiple amino acid substitutions. For ChOLS, some of the variants were designed by taking beneficial mutations discovered from screening of CsOLS variants described in Example 4 and mapping the corresponding mutations onto the ChOLS template. Corresponding positions in ChOLS were identified and mutated.

For CoOLS, some of the variants were designed to investigate whether there were any specific residues that may contribute to conferring or enhancing bifunctionality. The sequence of the bifunctional CoOLS enzyme (SEQ ID NO: 6) was aligned with the sequence of the CsOLS enzyme (SEQ ID NO: 5), which is not bifunctional, and residues that are different between the sequences were considered for mutagenesis in both the CsOLS and CoOLS sequences. The impact of these mutations on bifunctionality was investigated by measuring the ratio of production of olivetolic acid to olivetol. A specific residue that was investigated with respect to bifunctionality was residue W339 in CoOLS, which corresponds to residue S332 in CsOLS.

Nucleotide sequences of the genes within the library were codon-optimized for expression in *S. cerevisiae* and synthesized in the replicative yeast expression vector shown in FIGS. 5A-5B. Each candidate OLS expression construct was transformed into a *S. cerevisiae* CEN.PK strain expressing a heterologous AAE VcsA-Q6N4N8 from *R. palustris*. The library was screened in a high-throughput primary screen in which the OLS assay was conducted as described in Example 2, except that production cultures were not supplemented with either sodium hexanoate or sodium butyrate. Instead the strains' natural pools of hexanoyl-CoA and butyryl-CoA were used as substrates. Top olivetol and/or olivetolic acid producing strains were carried over to a secondary screen to verify production of olivetol and/or olivetolic acid. The experimental protocol for the secondary screen was identical to the primary screen, except that four replicates per strain were tested; and olivetol production was assessed both in the context of production cultures being supplemented with sodium hexanoate and in the context of production cultures that were not being supplemented with sodium hexanoate.

Strain t527338, expressing a fluorescent protein, was included in the library as a negative control for enzyme activity. Strain t527340, expressing wild-type CsOLS, was included in the library as a positive control. Strain t527346, expressing wild-type ChOLS, was included in the library as a positive control and was used to establish hit ranking for variants designed using ChOLS as a template. Similarly, strain t606797, expressing wild-type CoOLS, was included in the library as a positive control and was used to establish hit ranking for variants designed using CoOLS as a template. Olivetol was normalized to the mean production of its wild-type template (e.g., olivetol produced by a variant of ChOLS was normalized to the mean olivetol titer produced by strain t527346) except that for variants made to the CoOLS template, olivetol was normalized against each of a CsOLS template and a CoOLS template due to inconsistent activity of the CoOLS wild type control (Tables 10A-B and 11A-B). The Average Normalized Olivetol value for wild-type templates was not necessarily 1.0. For example, for the wild-type *C. saliva* strain t527340 in Table 10B, the Average Normalized Olivetol value was 1.02159. This was because the mean by which values were normalized was based on library controls that were included on each plate within a screen (e.g., strain t527340). The library further contained additional in-library controls of the same strain (e.g., strain t527340). Those additional in-library controls were not used to calculate the mean. In instances where the average normalized olivetol values for all samples of strain t527340 were calculated, if the in-library controls produced slightly more olivetol than the mean olivetol produced by the library controls that were included on each plate, then the Average Normalized Olivetol value was slightly above 1.0.

Results from the secondary screen are provided in Tables 10-11. Table 10 provides results for samples that were supplemented with sodium hexanoate, while Table 11 provides results for samples that were not supplemented with sodium hexanoate. In Table 10, strains comprising ChOLS mutants that produced an average normalized olivetol level of at least 0.5 are shown. The performance of multi-mutation ChOLS enzymes are also shown.

For ChOLS, the approach of mapping equivalent variants from the CsOLS sequence led to the identification of multiple variants that exhibited improved olivetol production. These variants included the following point mutations: V71Y, F70M, L385M, E285A, L76I, N151P, E203K, V50N, S34Q, R100P, A219C, K359M, and R100T (Table 11). Several additional variants exhibited improved olivetol production in samples that were supplemented with sodium hexanoate. These variants included the following point mutations: V71Y and F70M (Table 10).

For CoOLS, when the mutation W339S was made to the CoOLS template (strain t607112), the ratio of olivetolic acid to olivetol decreased, from approximately 1.5 to approximately 0.157 (based on 517.075 ug/L olivetol and 81.225 ug/L olivetolic acid, as shown in Table 10A). However, olivetol levels reported in Table 10A for strain t607112 were within the standard deviation. Accordingly, while the mutation may have had an impact on bifunctionality, it also appears to have more generally affected overall functionality of the enzyme. The reverse mutation was also tested in CsOLS. For CsOLS, S332W (strain t606899) had a significantly negative impact on the function of the enzyme (Table 10A). Similarly, mutation S339W in ChOLS (strain t607377) had a significantly negative impact on the overall function of the enzyme (Table 10A).

Example 6. Functional Expression of OLS Enzymes in a Prototrophic S. cerevisiae Strain Examples 2-5 utilized an auxotrophic S. cerevisiae CEN.PK strain as a host chassis for the expression of OLS enzyme candidates from a replicative plasmid. OLS candidate enzymes determined to be active in Examples 2-5 were also assessed in a prototrophic S. cerevisiae CEN.PK strain.

A library of approximately 58 OLS genes under the control of the same genetic regulatory elements shown in FIGS. 5A-5B (GAL1 promoter and CYC1 terminator) were integrated into the genome of a prototrophic S. cerevisiae CEN.PK strain. The parental chassis strain t473139, not expressing a heterologous OLS enzyme, was included as a negative control for enzyme activity. Strain t496084, expressing the CsOLS T335C point-mutant, which was the highest ranking CsOLS point mutant identified in Example 5 based on production of olivetol, was also included. The OLS assay was conducted as described in Example 2 with the following exceptions: glycerol stocks were stamped into YEP+4% glucose; a portion of the resulting cultures were then stamped into production cultures containing YEP+4% glucose+1 mM sodium hexanoate; and three bio-replicates were used instead of two.

Despite differences between auxotrophic and prototrophic strains that may impact production of olivetol, candidate OLS enzymes identified in Examples 2-5 through screening in auxotrophic strains were also found to be effective in production of olivetol in a prototrophic strain (Table 12 and FIG. 15). As shown in Table 12, strain t496073, corresponding to a prototrophic S. cerevisiae strain comprising a chromosomally integrated, codon-optimized nucleotide sequence encoding the OLS candidate from Cymbidium hybrid cultivar (Accession ID: A0A088G5Z5), which was identified in Examples 2 and 3, produced the highest olivetol titer of any library member and significantly more olivetol than the C. sativa control (FIG. 15 and Table 12).

Thus, novel candidate OLS enzymes identified in Examples 2-5 were found to be effective for olivetol production when expressed in prototrophic strains as well as auxotrophic strains.

Example 7. Biosynthesis of Cannabinoids in Engineered S. cerevisiae host cells

The activation of an organic acid to its CoA-thioester and the subsequent condensation of this thioester with a number of malonyl-CoA molecules, or other similar polyketide extender units, represent the first two steps in the biosynthesis of all known cannabinoids. To demonstrate the biosynthesis of CBGA (FIG. 1, Formula (8a)), CBDA (FIG. 1, Formula (9a)), THCA (FIG. 1, Formula (10a)), and CBCA (FIG. 1, Formula (11a)) the cannabinoid biosynthetic pathway shown in FIG. 1 is assembled in the genome of a prototrophic S. cerevisiae CEN.PK host cell wherein each enzyme (R1a-R5a) may be present in one or more copies. For example, the S. cerevisiae host cell may express one or more copies of one or more of: an AAE, an OLS, an OAC, a CBGAS, and a TS.

An AAE enzyme expressed heterologously in a host cell may be one or more of the AAE candidates from Y. lipolytica or R. palustris that are shown in Example 1 to be functionally expressed in S. cerevisiae. An OLS enzyme expressed heterologously in a host cell may be an OLS identified and characterized in Examples 2-8, such as a Cymbidium hybrid cultivar OLS (SEQ ID NO: 7) or a Phalaenopsis x Doritaenopsis hybrid cultivar OLS (SEQ ID NO: 15), or an OLS corresponding to SEQ ID NO: 145. The OLS enzyme may also be an engineered OLS such as CsOLS T335C (SEQ ID NO: 207) or an engineered version of any other OLS enzyme described in this disclosure. An OAC enzyme expressed heterologously in a host cell may be a naturally occurring or synthetic OAC that is functionally expressed in S. cerevisiae, or a variant thereof, including an OAC from C. sativa or a variant of an OAC from C. sativa. In instances where a bifunctional OLS, such as Corchorus olitorius OLS (SEQ ID NO: 6), is used, a separate OAC enzyme may be omitted.

A CBGAS enzyme, such as a PT enzyme, expressed heterologously in a host cell may be a naturally occurring or synthetic PT that is functionally expressed in S. cerevisiae, or a variant thereof, including a PT from C. sativa or a variant of a PT from C. sativa. For example, a PT may comprise CsPT4 from C. sativa, or a variant thereof, or NphB from Streptomyces sp. Strain CL 190, or a variant thereof.

A TS enzyme expressed heterologously in a host cell may be a naturally occurring or synthetic TS that is functionally expressed in S. cerevisiae, or a variant thereof, including a TS from C. sativa or a variant of a TS from C. sativa. The TS enzyme may be a TS that produces one or more of CBDA, THCA, and CBCA as a majority product.

The cannabinoid fermentation procedure may be similar to the OLS assay described in the Examples above with the following exceptions: the incubation of production cultures may last from, for example, 48-144 hours, and production cultures may be supplemented with, for example, 4% galactose and 1mM sodium hexanoate approximately every 24 hours. Titers of CBGA, CBDA, THCA, and CBCA may be quantified via LC-MS.

It should be appreciated that sequences disclosed herein may or may not contain signal sequences. The sequences disclosed herein encompass versions with or without signal sequences. It should also be understood that protein sequences disclosed herein may be depicted with or without a start codon (M). Accordingly, in some instances amino acid numbering may correspond to protein sequences containing a start codon, while in other instances, amino acid numbering may correspond to protein sequences that do not contain a start codon. Aspects of the disclosure encompass host cells comprising any of the sequences described herein, including the sequences within Tables 4-6, and 13-16 and fragments thereof.

TABLE 4

Sequence Information For Strains Described in Example 1

| Strain ID | AAE Sequence Information |
|---|---|
| t49578 (*E. coli*) | This strain comprises a codon-optimized nucleic acid (SEQ ID NO: 70), which encodes a *Yarrowia lipolytica* protein (SEQ ID NO: 63). The protein sequence of SEQ ID NO: 63 corresponds to the protein sequence provided by UniProt Accession No. Q6CFE4. |
| t49594 (*E. coli*) | This strain comprises a codon-optimized nucleic acid (SEQ ID NO: 71), which encodes a *Yarrowia lipolytica* protein (SEQ ID NO: 64). The protein sequence of SEQ ID NO: 64 corresponds to the protein sequence provided by UniProt Accession No. Q6C577. This protein was expressed as a fusion protein with an N-terminal MYC tag (SEQ ID NO: 140). SEQ ID NO: 707 corresponds to the fusion protein. SEQ ID NO: 712 is a codon-optimized nucleic acid encoding SEQ ID NO: 707. |
| t51477 (*E. coli*) | This strain comprises a codon-optimized nucleic acid (SEQ ID NO: 72), which encodes a *Yarrowia lipolytica* protein (SEQ ID NO: 65). The protein sequence of SEQ ID NO: 65 corresponds to the protein sequence provided by UniProt Accession No. Q6C650. This protein was expressed as a fusion protein with an N-terminal MYC tag (SEQ ID NO: 140). SEQ ID NO: 708 corresponds to the fusion protein). SEQ ID NO: 713 is a codon-optimized nucleic acid encoding SEQ ID NO: 708. |
| t392878 (*S. cerevisiae*) | This strain comprises a codon-optimized nucleic acid (SEQ ID NO: 75), which encodes a *Yarrowia lipolytica* protein (SEQ ID NO: 141). SEQ ID NO: 141 corresponds to residues 1-595 of SEQ ID NO: 68. The protein sequence of (SEQ ID NO: 141) corresponds to the protein sequence provided by UniProt Accession No. Q6C577 except that the last three residues (peroxisomal targeting signal 1) were removed. |
| t392879 (*S. cerevisiae*) | This strain comprises a codon-optimized nucleic acid (SEQ ID NO: 76), which encodes a *Yarrowia lipolytica* protein (SEQ ID NO: 142). SEQ ID NO: 142 corresponds to residues 1-595 of SEQ ID NO: 69. The protein sequence of (SEQ ID NO: 142) corresponds to the protein sequence provided by UniProt Accession No. Q6C577 except that the last three residues (peroxisomal targeting signal 1) were removed. |
| t55127 (*E. coli*) | This strain comprises a codon-optimized nucleic acid (SEQ ID NO: 73), which encodes a *Rhodopseudotnonas palustris* protein (SEQ ID NO: 66). The protein sequence of SEQ ID NO: 66 corresponds to the protein sequence provided by UniProt Accession No. Q6N948. |
| t55128 (*E. coli*) | This strain comprises a codon-optimized nucleic acid (SEQ ID NO: 74), which encodes a Rhodopseudotnonas palustris protein (SEQ ID NO: 67). The protein sequence of SEQ ID NO: 67 corresponds to the protein sequence provided by UniProt Accession No. Q6N4N8. |
| t49580 (*E. coli*) | This strain comprises a codon-optimized nucleic acid (SEQ ID NO:72), which encodes a *Yarrowia lipolytica* protein (SEQ ID NO: 65). The protein sequence of SEQ ID NO: 65 corresponds to the protein sequence provided by UniProt Accession No. Q6C650. |

TABLE 5

Sequence Information for Strains Described in Example 2 and FIGs. 8-10

| Strain ID | OLS Sequence Information |
|---|---|
| t394087 | This strain comprises a codon-optimized nucleic acid that corresponds to nucleotides 3-1182 of SEQ ID NO: 32 (due to a truncation of nucleotides 1-2 of SEQ ID NO: 32). Translation of this sequence is expected to produce a truncated version of a protein corresponding to SEQ ID NO. 1. The protein sequence of SEQ ID NO: 1 corresponds to the protein sequence provided by UniProt Accession No. A0A2G5F4L7, from *Aquilegia coerulea* (Rocky mountain columbine) |
| t394687 | This strain comprises a codon-optimized nucleic acid that corresponds to nucleotides 3-1179 of SEQ ID NO: 33 (due to a truncation of nucleotides 1-2 of SEQ ID NO: 33). Translation of this sequence is expected to produce a truncated version of a protein corresponding to SEQ ID NO. 2. The protein sequence of SEQ ID NO: 2 corresponds to the protein sequence provided by UniProt Accession No. I6VW41, from *Vitis pseudoreticulata* (Chinese wild grapevine) |
| t393495 | This strain comprises a codon-optimized nucleic acid that corresponds to nucleotides 3-1185 of SEQ ID NO: 34 (due to a truncation of nucleotides 1-2 of SEQ ID NO: 34). Translation of this sequence is expected to produce a truncated version of a protein corresponding to SEQ ID NO. 3. The protein sequence of SEQ ID NO: 3 corresponds to the protein sequence provided by UniProt Accession No. M4DVZ4, from *Brassica rapa* subsp. *pekinensis* (Chinese cabbage) (*Brassica pekinensis*) |
| t393563 | This strain comprises a codon-optimized nucleic acid that corresponds to nucleotides 3-1197 of SEQ ID NO: 35 (due to a truncation of nucleotides 1-2 of SEQ ID NO: 35). Translation of this sequence is expected to produce a truncated version of a protein corresponding to SEQ ID NO. 4. The protein sequence of SEQ ID NO: 4 corresponds to the protein sequence provided by UniProt Accession No. Q8VWQ7, from *Sorghum bicolor* (*Sorghum*) (*Sorghum vulgare*) |
| t339568 | This strain comprises a codon-optimized nucleic acid that corresponds to nucleotides 3-1158 of SEQ ID NO: 36 (due to a truncation of nucleotides 1-2 of SEQ ID NO: 36). Translation of this sequence is expected to produce a truncated version of a protein corresponding to SEQ ID NO. 5. The protein sequence of SEQ ID NO: 5 corresponds to the protein sequence provided by UniProt Accession No. B1Q2B6, from *Cannabis sativa* |
| t393974 | This strain comprises a codon-optimized nucleic acid that corresponds to nucleotides 3-1191 of SEQ ID NO: 37 (due to a truncation of nucleotides 1-2 of SEQ ID NO: 37). Translation of this sequence is expected to produce a truncated version of a protein corresponding to SEQ ID NO. 6. The protein sequence of SEQ ID NO: 6 corresponds to the protein sequence provided by UniProt Accession No. A0A1R3HSU5, from *Corchorus olitorius* |

TABLE 5-continued

Sequence Information for Strains Described in Example 2 and FIGs. 8-10

| Strain ID | OLS Sequence Information |
|---|---|
| t393991 | This strain comprises a codon-optimized nucleic acid that corresponds to nucleotides 3-1173 of SEQ ID NO: 38 (due to a truncation of nucleotides 1-2 of SEQ ID NO: 38). Translation of this sequence is expected to produce a truncated version of a protein corresponding to SEQ ID NO. 7. The protein sequence of SEQ ID NO: 7 corresponds to the protein sequence provided by UniProt Accession No. A0A088G5Z5, from *Cymbidium* hybrid cultivar |
| t394336 | This strain comprises a codon-optimized nucleic acid that corresponds to nucleotides 3-1185 of SEQ ID NO: 39 (due to a truncation of nucleotides 1-2 of SEQ ID NO: 39). Translation of this sequence is expected to produce a truncated version of a protein corresponding to SEQ ID NO. 8. The protein sequence of SEQ ID NO: 8 corresponds to the protein sequence provided by UniProt Accession No. A0A0A6Z8B1, from *Paphiopedilum helenae* |
| t394547 | This strain comprises a codon-optimized nucleic acid that corresponds to nucleotides 3-1185 of SEQ ID NO: 40 (due to a truncation of nucleotides 1-2 of SEQ ID NO: 40). Translation of this sequence is expected to produce a truncated version of a protein corresponding to SEQ ID NO. 9. The protein sequence of SEQ ID NO: 9 corresponds to the protein sequence provided by UniProt Accession No. A0A078IM49, from *Brassica napus* (Rape) |
| t394457 | This strain comprises a codon-optimized nucleic acid that corresponds to nucleotides 3-1191 of SEQ ID NO: 41 (due to a truncation of nucleotides 1-2 of SEQ ID NO: 41). Translation of this sequence is expected to produce a truncated version of a protein corresponding to SEQ ID NO. 10. The protein sequence of SEQ ID NO: 10 corresponds to the protein sequence provided by UniProt Accession No. A0A140KXU1, from *Picea jezoensis* |
| t394521 | This strain comprises a codon-optimized nucleic acid that corresponds to nucleotides 3-1191 of SEQ ID NO: 42 (due to a truncation of nucleotides 1-2 of SEQ ID NO: 42). Translation of this sequence is expected to produce a truncated version of a protein corresponding to SEQ ID NO. 11. The protein sequence of SEQ ID NO: 11 corresponds to the protein sequence provided by UniProt Accession No. P48408, from *Pinus strobus* (Eastern white pine) |
| t394790 | This strain comprises a codon-optimized nucleic acid that corresponds to nucleotides 3-1170 of SEQ ID NO: 43 (due to a truncation of nucleotides 1-2 of SEQ ID NO: 43). Translation of this sequence is expected to produce a truncated version of a protein corresponding to SEQ ID NO. 12. The protein sequence of SEQ ID NO: 12 corresponds to the protein sequence provided by UniProt Accession No. I3QQ50, from *Arachis hypogaea* (Peanut) |
| t394905 | This strain comprises a codon-optimized nucleic acid that corresponds to nucleotides 3-1296 of SEQ ID NO: 44 (due to a truncation of nucleotides 1-2 of SEQ ID NO: 44). Translation of this sequence is expected to produce a truncated version of a protein corresponding to SEQ ID NO. 13. The protein sequence of SEQ ID NO: 13 corresponds to the protein sequence provided by UniProt Accession No. A0A1S4ATN2, from *Nicotiana tabacum* (Common tobacco) |
| t394981 | This strain comprises a codon-optimized nucleic acid that corresponds to nucleotides 3-1197 of SEQ ID NO: 45 (due to a truncation of nucleotides 1-2 of SEQ ID NO: 45). Translation of this sequence is expected to produce a truncated version of a protein corresponding to SEQ ID NO. 14. The protein sequence of SEQ ID NO: 14 corresponds to the protein sequence provided by UniProt Accession No. K3Y7T4, from *Setaria italica* (Foxtail millet) (*Panicum italicum*) |
| t395011 | This strain comprises a codon-optimized nucleic acid that corresponds to nucleotides 3-1173 of SEQ ID NO: 46 (due to a truncation of nucleotides 1-2 of SEQ ID NO: 46). Translation of this sequence is expected to produce a truncated version of a protein corresponding to SEQ ID NO. 15. The protein sequence of SEQ ID NO: 15 corresponds to the protein sequence provided by UniProt Accession No. Q6WJD6, from *Phalaenopsis x Doritaenopsis* hybrid cultivar |
| t394797 | This strain comprises a codon-optimized nucleic acid that corresponds to nucleotides 3-1170 of SEQ ID NO: 47 (due to a truncation of nucleotides 1-2 of SEQ ID NO: 47). Translation of this sequence is expected to produce a truncated version of a protein corresponding to SEQ ID NO. 16. The protein sequence of SEQ ID NO: 16 corresponds to the protein sequence provided by UniProt Accession No. K7XD27, from *Arachis hypogaea* (Peanut) |
| t395094 | This strain comprises a codon-optimized nucleic acid that corresponds to nucleotides 3-1179 of SEQ ID NO: 48 (due to a truncation of nucleotides 1-2 of SEQ ID NO: 48). Translation of this sequence is expected to produce a truncated version of a protein corresponding to SEQ ID NO. 17. The protein sequence of SEQ ID NO: 17 corresponds to the protein sequence provided by UniProt Accession No. A0A0D6QTX3, from *Araucaria cunninghamii* (Hoop pine) (Moreton Bay pine) |
| t395103 | This strain comprises a codon-optimized nucleic acid that corresponds to nucleotides 3-1182 of SEQ ID NO: 49 (due to a truncation of nucleotides 1-2 of SEQ ID NO: 49). Translation of this sequence is expected to produce a truncated version of a protein corresponding to SEQ ID NO. 18. The protein sequence of SEQ ID NO: 18 corresponds to the protein sequence provided by UniProt Accession No. V7AZ15, from *Phaseolus vulgaris* (common bean) |
| t393835 | This strain comprises a codon-optimized nucleic acid that corresponds to nucleotides 3-1179 of SEQ ID NO: 50 (due to a truncation of nucleotides 1-2 of SEQ ID NO: 50). Translation of this sequence is expected to produce a truncated version of a protein corresponding to SEQ ID NO. 19. The protein sequence of SEQ ID NO: 19 corresponds to the protein sequence provided by UniProt Accession No. I6S977, from *Vitis quinquangularis* |
| t394115 | This strain comprises a codon-optimized nucleic acid that corresponds to nucleotides 3-1188 of SEQ ID NO: 51 (due to a truncation of nucleotides 1-2 of SEQ ID NO: 51). Translation of this sequence is expected to produce a truncated version of a protein corresponding to SEQ ID NO: 20. The protein sequence of SEQ ID NO: 20 corresponds to the protein sequence provided by UniProt Accession No. Q9FR69, from *Cardamine penzesii* |
| t394091 | This strain comprises a codon-optimized nucleic acid that corresponds to nucleotides 3-1170 of SEQ ID NO: 52 (due to a truncation of nucleotides 1-2 of SEQ ID NO: 52). Translation of this sequence is expected to produce a truncated version of a protein corresponding to SEQ ID NO. 21. The protein sequence of SEQ ID NO: 21 corresponds to the protein sequence provided by UniProt Accession No. G7IQL2, from *Medicago truncatula* (Barrel medic) (*Medicago tribuloides*) |

TABLE 5-continued

Sequence Information for Strains Described in Example 2 and FIGs. 8-10

| Strain ID | OLS Sequence Information |
|---|---|
| t394037 | This strain comprises a codon-optimized nucleic acid that corresponds to nucleotides 3-1179 of SEQ ID NO: 53 (due to a truncation of nucleotides 1-2 of SEQ ID NO: 53). Translation of this sequence is expected to produce a truncated version of a protein corresponding to SEQ ID NO. 22. The protein sequence of SEQ ID NO: 22 corresponds to the protein sequence provided by UniProt Accession No. I6W888, from *Vitis pseudoreticulata* (Chinese wild grapevine) |
| t394279 | This strain comprises a codon-optimized nucleic acid that corresponds to nucleotides 3-1188 of SEQ ID NO: 54 (due to a truncation of nucleotides 1-2 of SEQ ID NO: 54). Translation of this sequence is expected to produce a truncated version of a protein corresponding to SEQ ID NO. 23. The protein sequence of SEQ ID NO: 23 corresponds to the protein sequence provided by UniProt Accession No. P13114, from *Arabidopsis thaliana* (Mouse-ear cress) |
| t394043 | This strain comprises a codon-optimized nucleic acid that corresponds to nucleotides 3-1344 of SEQ ID NO: 55 (due to a truncation of nucleotides 1-2 of SEQ ID NO: 55). Translation of this sequence is expected to produce a truncated version of a protein corresponding to SEQ ID NO. 24. The protein sequence of SEQ ID NO: 24 corresponds to the protein sequence provided by UniProt Accession No. A0A251SHA8, from *Helianthus annuus* (Common sunflower) |
| t394404 | This strain comprises a codon-optimized nucleic acid that corresponds to nucleotides 3-1170 of SEQ ID NO: 56 (due to a truncation of nucleotides 1-2 of SEQ ID NO: 56). Translation of this sequence is expected to produce a truncated version of a protein corresponding to SEQ ID NO. 25. The protein sequence of SEQ ID NO: 25 corresponds to the protein sequence provided by UniProt Accession No. X5I326, from *Vaccinium ashei* |
| t394436 | This strain comprises a codon-optimized nucleic acid that corresponds to nucleotides 3-1197 of SEQ ID NO: 57 (due to a truncation of nucleotides 1-2 of SEQ ID NO: 57). Translation of this sequence is expected to produce a truncated version of a protein corresponding to SEQ ID NO. 26. The protein sequence of SEQ ID NO: 26 corresponds to the protein sequence provided by UniProt Accession No. A0A164ZDA1, from *Daucus carota* sub sp. *Sativus* |
| t393720 | This strain comprises a codon-optimized nucleic acid that corresponds to nucleotides 3-1212 of SEQ ID NO: 58 (due to a truncation of nucleotides 1-2 of SEQ ID NO: 58). Translation of this sequence is expected to produce a truncated version of a protein corresponding to SEQ ID NO. 27. The protein sequence of SEQ ID NO: 27 corresponds to the protein sequence provided by UniProt Accession No. Q58VP7, from *Aloe arborescens* (Kidachi aloe) |
| t394911 | This strain comprises a codon-optimized nucleic acid that corresponds to nucleotides 3-1203 of SEQ ID NO: 59 (due to a truncation of nucleotides 1-2 of SEQ ID NO: 59). Translation of this sequence is expected to produce a truncated version of a protein corresponding to SEQ ID NO. 28. The protein sequence of SEQ ID NO: 28 corresponds to the protein sequence provided by UniProt Accession No. A0A2K3P0B5, from *Trifolium pratense* (Red clover) |
| t395023 | This strain comprises a codon-optimized nucleic acid that corresponds to nucleotides 3-1200 of SEQ ID NO: 60 (due to a truncation of nucleotides 1-2 of SEQ ID NO: 60). Translation of this sequence is expected to produce a truncated version of a protein corresponding to SEQ ID NO. 29. The protein sequence of SEQ ID NO: 29 corresponds to the protein sequence provided by UniProt Accession No. Q8GZP4, from *Hydrangea macrophylla* (Bigleaf hydrangea) (*Viburnum macrophyllum*) |
| t339579 | This strain comprises a codon-optimized nucleic acid that corresponds to nucleotides 3-1158 of SEQ ID NO: 61 (due to a truncation of nucleotides 1-2 of SEQ ID NO: 61). Translation of this sequence is expected to produce a truncated version of a protein corresponding to SEQ ID NO. 30. The protein sequence of SEQ ID NO: 30 corresponds to the protein sequence provided by UniProt Accession No. B1Q2B6, from *C. sativa* |
| t339582 | This strain comprises a codon-optimized nucleic acid that corresponds to nucleotides 3-1158 of SEQ ID NO: 62 (due to a truncation of nucleotides 1-2 of SEQ ID NO: 62). Translation of this sequence is expected to produce a truncated version of a protein corresponding to SEQ ID NO. 31. The protein sequence of SEQ ID NO: 31 corresponds to the protein sequence provided by UniProt Accession No. B1Q2B6, from *C. sativa* |
| t394396 | This strain comprises a codon-optimized nucleic acid that corresponds to nucleotides 3-1158 of SEQ ID NO: 93 (due to a truncation of nucleotides 1-2 of SEQ ID NO: 93). Translation of this sequence is expected to produce a truncated version of a protein corresponding to SEQ ID NO. 77. The protein sequence of SEQ ID NO: 77 corresponds to the protein sequence provided by UniProt Accession No. B1Q2B6, from *C. sativa* |
| t339546 | This strain comprises a codon-optimized nucleic acid that corresponds to nucleotides 3-1158 of SEQ ID NO: 94 (due to a truncation of nucleotides 1-2 of SEQ ID NO: 94). Translation of this sequence is expected to produce a truncated version of a protein corresponding to SEQ ID NO: 78. The protein sequence of SEQ ID NO: 78 corresponds to the protein sequence provided by UniProt Accession No. B1Q2B6, from *C. sativa*. |
| t339549 | This strain comprises a codon-optimized nucleic acid that corresponds to nucleotides 3-1158 of SEQ ID NO: 95 (due to a truncation of nucleotides 1-2 of SEQ ID NO: 95). Translation of this sequence is expected to produce a truncated version of a protein corresponding to SEQ ID NO. 79. The protein sequence of SEQ ID NO: 79 corresponds to the protein sequence provided by UniProt Accession No. B1Q2B6, from *C. sativa* |
| t393360 | This strain comprises a codon-optimized nucleic acid that corresponds to nucleotides 3-1158 of SEQ ID NO: 96 (due to a truncation of nucleotides 1-2 of SEQ ID NO: 96). Translation of this sequence is expected to produce a truncated version of a protein corresponding to SEQ ID NO. 80. The protein sequence of SEQ ID NO: 80 corresponds to the protein sequence provided by UniProt Accession No. F1LKH5, from *C. sativa* |
| t393555 | This strain comprises a codon-optimized nucleic acid that corresponds to nucleotides 3-1188 of SEQ ID NO: 97 (due to a truncation of nucleotides 1-2 of SEQ ID NO: 97). Translation of this sequence is expected to produce a truncated version of a protein corresponding to SEQ ID NO. 81. The protein sequence of SEQ ID NO: 81 corresponds to the protein sequence provided by UniProt Accession No. Q9SEN0, from *Fourraea alpina* (Rock-cress) (*Arabis pauciflora*) |

TABLE 5-continued

Sequence Information for Strains Described in Example 2 and FIGs. 8-10

| Strain ID | OLS Sequence Information |
|---|---|
| t394593 | This strain comprises a codon-optimized nucleic acid that corresponds to nucleotides 3-1197 of SEQ ID NO: 98 (due to a truncation of nucleotides 1-2 of SEQ ID NO: 98). Translation of this sequence is expected to produce a truncated version of a protein corresponding to SEQ ID NO. 82. The protein sequence of SEQ ID NO: 82 corresponds to the protein sequence provided by UniProt Accession No. A0A059VFD5, from *Punica granatum* (Pomegrate) |
| t394351 | This strain comprises a codon-optimized nucleic acid that corresponds to nucleotides 3-1167 of SEQ ID NO: 99 (due to a truncation of nucleotides 1-2 of SEQ ID NO: 99). Translation of this sequence is expected to produce a truncated version of a protein corresponding to SEQ ID NO. 83. The protein sequence of SEQ ID NO: 83 corresponds to the protein sequence provided by UniProt Accession No. Q1G6T7, from *Cardamine apennina* |
| t394414 | This strain comprises a codon-optimized nucleic acid that corresponds to nucleotides 3-1068 of SEQ ID NO: 100 (due to a truncation of nucleotides 1-2 of SEQ ID NO: 100). Translation of this sequence is expected to produce a truncated version of a protein corresponding to SEQ ID NO. 84. The protein sequence of SEQ ID NO: 84 corresponds to the protein sequence provided by UniProt Accession No. A0A2T5VUN1, from *Mycobacterium* sp. YR782 |
| t393402 | This strain comprises a codon-optimized nucleic acid that corresponds to nucleotides 3-1173 of SEQ ID NO: 101 (due to a truncation of nucleotides 1-2 of SEQ ID NO: 101). Translation of this sequence is expected to produce a truncated version of a protein corresponding to SEQ ID NO. 85. The protein sequence of SEQ ID NO: 85 corresponds to the protein sequence provided by UniProt Accession No. A0A1Q9SCX4, from *Kocuria* sp. CNJ-770 |
| t394035 | This strain comprises a codon-optimized nucleic acid that corresponds to nucleotides 3-675 of SEQ ID NO: 102 (due to a truncation of nucleotides 1-2 of SEQ ID NO: 102). Translation of this sequence is expected to produce a truncated version of a protein corresponding to SEQ ID NO. 86. The protein sequence of SEQ ID NO: 86 corresponds to the protein sequence provided by UniProt Accession No. A0A0K8QHJ1 from *Arthrobacter* sp. Hiyo1 |
| t394155 | This strain comprises a codon-optimized nucleic acid that corresponds to nucleotides 3-1176 of SEQ ID NO: 103 (due to a truncation of nucleotides 1-2 of SEQ ID NO: 103). Translation of this sequence is expected to produce a truncated version of a protein corresponding to SEQ ID NO. 87. The protein sequence of SEQ ID NO: 87 corresponds to the protein sequence provided by UniProt Accession No. Q9XJ57 from *Citrus sinensis* (Sweet orange) (*Citrus aurantium* var. *sinensis*) |
| t394137 | This strain comprises a codon-optimized nucleic acid that corresponds to nucleotides 3-1173 of SEQ ID NO: 104 (due to a truncation of nucleotides 1-2 of SEQ ID NO: 104). Translation of this sequence is expected to produce a truncated version of a protein corresponding to SEQ ID NO. 88. The protein sequence of SEQ ID NO: 88 corresponds to the protein sequence provided by UniProt Accession No. I6R2S0 from *Narcissus tazetta* var. *chinensis* |
| t393976 | This strain comprises a codon-optimized nucleic acid that corresponds to nucleotides 3-1188 of SEQ ID NO: 105 (due to a truncation of nucleotides 1-2 of SEQ ID NO: 105). Translation of this sequence is expected to produce a truncated version of a protein corresponding to SEQ ID NO. 89. The protein sequence of SEQ ID NO: 89 corresponds to the protein sequence provided by UniProt Accession No. Q2ENA5 from *Abies alba* (Edeltanne) (European silver fir) |
| t394689 | This strain comprises a codon-optimized nucleic acid that corresponds to nucleotides 3-1173 of SEQ ID NO: 106 (due to a truncation of nucleotides 1-2 of SEQ ID NO: 106). Translation of this sequence is expected to produce a truncated version of a protein corresponding to SEQ ID NO. 90. The protein sequence of SEQ ID NO: 90 corresponds to the protein sequence provided by UniProt Accession No. A0A022RTH3 from *Erythranthe guttata* (Yellow monkey flower) |
| t393400 | This strain comprises a codon-optimized nucleic acid that corresponds to nucleotides 3-1053 of SEQ ID NO: 107 (due to a truncation of nucleotides 1-2 of SEQ ID NO: 107). Translation of this sequence is expected to produce a truncated version of a protein corresponding to SEQ ID NO. 91. The protein sequence of SEQ ID NO: 91 corresponds to the protein sequence provided by UniProt Accession No. A0A2T7T652 from *Streptomyces scopuliridis* RB72 |
| t394693 | This strain comprises a codon-optimized nucleic acid that corresponds to nucleotides 3-1188 of SEQ ID NO: 108 (due to a truncation of nucleotides 1-2 of SEQ ID NO: 108). Translation of this sequence is expected to produce a truncated version of a protein corresponding to SEQ ID NO: 92. The protein sequence of SEQ ID NO: 92 corresponds to the protein sequence provided by UniProt Accession No. Q2EFKO, from *Abies alba* (Edeltanne) (European silver fir) |

TABLE 6

Sequence Information for Strains Described in Example 3 and Tables 7 and 8

| Strain | OLS Nucleotide Sequence (SEQ ID NO) | OLS Protein Sequence (SEQ ID NO) |
|---|---|---|
| t527340 | 62 | 5 |
| t527346 | 38 | 7 |
| t599285 | 172 | 17 |
| t598244 | 173 | 143 |
| t598490 | 174 | 144 |
| t598916 | 175 | 145 |
| t598301 | 176 | 7 |
| t598212 | 177 | 146 |
| t598424 | 178 | 147 |
| t598578 | 179 | 148 |
| t598836 | 180 | 149 |
| t597770 | 181 | 150 |
| t597768 | 182 | 151 |
| t599210 | 183 | 152 |
| t597806 | 184 | 153 |
| t598184 | 185 | 154 |
| t598084 | 186 | 6 |
| t598989 | 187 | 155 |

TABLE 6-continued

Sequence Information for Strains Described in Example 3 and Tables 7 and 8

| Strain | OLS Nucleotide Sequence (SEQ ID NO) | OLS Protein Sequence (SEQ ID NO) |
|---|---|---|
| t598609 | 188 | 156 |
| t598907 | 189 | 157 |
| t598159 | 190 | 158 |
| t598607 | 191 | 159 |
| t598132 | 192 | 160 |
| t598202 | 193 | 161 |
| t598224 | 194 | 162 |
| t598242 | 195 | 163 |
| t598265 | 196 | 13 |
| t598502 | 197 | 164 |
| t598669 | 198 | 165 |
| t598828 | 199 | 166 |
| t598888 | 200 | 167 |
| t598890 | 201 | 168 |
| t598897 | 202 | 169 |
| t598965 | 203 | 170 |
| t598976 | 204 | 8 |
| t599231 | 205 | 15 |
| t599271 | 206 | 171 |

TABLE 7

Production of Olivetol and Olivetolic Acid in Secondary Screen of Full-Length OLS Library (with sodium hexanoate supplementation)

| Strain | Strain type | Average Olivetol [ug/L] | Standard Deviation Olivetol [ug/L] | Average Olivetolic Acid [ug/L] | Standard Deviation Olivetolic Acid [ug/L] | Average Normalized Olivetol (per OD) | Standard Deviation Normalized Olivetol |
|---|---|---|---|---|---|---|---|
| t527338 | GFP Negative Control | 0 | 0 | 0 | 0 | 0 | 0 |
| t527340 | Cannabis OLS Positive Control | 19907.37 | 3392.375 | 464.2222 | 119.0458 | 1 | 0.17338 |
| t527346 | Library | 47674.72 | 7310.215 | 1126.656 | 275.7896 | 2.577378 | 0.5328 |
| t599285 | Library | 40719.68 | 5413.028 | 1006.4 | 205.3059 | 1.570539 | 0.12684 |
| t598244 | Library | 30067.48 | 2678.216 | 1328.625 | 391.3286 | 2.322177 | 0.24813 |
| t598490 | Library | 29983.43 | 7816.659 | 895.1 | 368.4323 | 1.423788 | 0.286677 |
| t598916 | Library | 23515.18 | 1702.502 | 680.575 | 66.45968 | 0.938026 | 0.042088 |
| t598301 | Library | 21070.73 | 12453.97 | 512.175 | 274.8916 | 0.881438 | 0.570619 |
| t598212 | Library | 19864.23 | 6981.826 | 582.3 | 129.3529 | 1.315837 | 0.25006 |
| t598424 | Library | 18263.73 | 3738.191 | 661.325 | 148.2432 | 0.782173 | 0.157387 |
| t598578 | Library | 18167.93 | 1534.837 | 614.4 | 62.65115 | 0.733176 | 0.065004 |
| t598836 | Library | 17825.58 | 3298.654 | 614.75 | 139.553 | 0.67585 | 0.216607 |
| t597770 | Library | 16611.23 | 2805.423 | 565.575 | 87.49584 | 1.203593 | 0.740925 |
| t597768 | Library | 16140.08 | 2088.271 | 469.65 | 58.01394 | 0.72298 | 0.123509 |
| t599210 | Library | 3019.65 | 187.1009 | 4913.925 | 344.6286 | 0.0939 | 0.012992 |
| t597806 | Library | 1452.425 | 194.0261 | 872.65 | 58.60117 | 0.096846 | 0.040743 |
| t598184 | Library | 466.15 | 76.41424 | 6016.625 | 5727.47 | 0.033016 | 0.009583 |
| t598084 | Library | 298.6 | 38.96913 | 711.85 | 86.71242 | 0.012889 | 0.003159 |
| t598989 | Library | 192.725 | 3.557504 | 981.225 | 924.6046 | 0.008438 | 0.000605 |
| t598609 | Library | 97.025 | 65.64777 | 490.925 | 484.0728 | 0.003307 | 0.002213 |
| t598907 | Library | 97 | 66.37625 | 539.75 | 809.4711 | 0.004664 | 0.0034 |
| t598159 | Library | 73.825 | 50.2624 | 1014.55 | 98.44669 | 0.003517 | 0.002408 |
| t598607 | Library | 57.9 | 67.11512 | 1006.4 | 227.8435 | 0.0017 | 0.001963 |

TABLE 8

Production of Olivetol and Olivetolic Acid in Secondary Screen of Full-Length OLS Library (without sodium hexanoate supplementation)

| Strain | Strain type | Average Olivetol [ug/L] | Standard Deviation Olivetol [ug/L] | Average Olivetolic Acid [ug/L] | Standard Deviation Olivetolic Acid [ug/L] | Average Normalized Olivetol (per OD) | Standard Deviation Normalized Olivetol |
|---|---|---|---|---|---|---|---|
| t527338 | GFP Negative Control | 0 | 0 | 0 | 0 | 0 | 0 |
| t527340 | Cannabis OLS Positive Control | 233.5102 | 24.98585 | 0.139276 | 0.5909 | 1 | 0.15846 |
| t527346 | Library | 726.4307 | 68.37505 | 0.431449 | 1.830482 | 3.072299 | 0.594866 |
| t597768 | Library | 313.8253 | 41.20191 | 0 | 0 | 1.887013 | 0.355292 |
| t597770 | Library | 600.919 | 84.71989 | 0 | 0 | 2.958839 | 0.883218 |
| t598084 | Library | 41.65336 | 27.90324 | 143.5728 | 17.13177 | 0.203694 | 0.149696 |
| t598132 | Library | 430.7581 | 98.35626 | 0 | 0 | 2.045727 | 0.229508 |
| t598202 | Library | 629.8948 | 43.73374 | 0 | 0 | 2.319367 | 0.145214 |

TABLE 8-continued

Production of Olivetol and Olivetolic Acid in Secondary Screen of Full-Length OLS Library (without sodium hexanoate supplementation)

| Strain | Strain type | Average Olivetol [ug/L] | Standard Deviation Olivetol [ug/L] | Average Olivetolic Acid [ug/L] | Standard Deviation Olivetolic Acid [ug/L] | Average Normalized Olivetol (per OD) | Standard Deviation Normalized Olivetol |
|---|---|---|---|---|---|---|---|
| t598212 | Library | 439.2199 | 23.32112 | 0 | 0 | 2.133233 | 0.157933 |
| t598224 | Library | 535.1348 | 45.55404 | 4.682865 | 1.486543 | 2.001014 | 0.151286 |
| t598242 | Library | 444.4074 | 36.07498 | 0 | 0 | 2.509074 | 0.247446 |
| t598244 | Library | 780.646 | 10.19476 | 21.86307 | 21.3525 | 4.250859 | 0.503227 |
| t598265 | Library | 399.8005 | 24.89199 | 0 | 0 | 2.005431 | 0.247479 |
| t598301 | Library | 523.4047 | 10.23296 | 0 | 0 | 2.980013 | 0.751203 |
| t598424 | Library | 1039.723 | 20.19861 | 22.23645 | 1.606142 | 6.95869 | 1.19209 |
| t598490 | Library | 1042.654 | 162.3917 | 12.97602 | 6.917579 | 5.733983 | 1.383711 |
| t598502 | Library | 649.3324 | 105.1879 | 0 | 0 | 3.49989 | 0.626512 |
| t598578 | Library | 666.2518 | 167.478 | 0 | 0 | 3.35228 | 0.956232 |
| t598669 | Library | 555.1264 | 124.4665 | 0 | 0 | 3.070987 | 0.828156 |
| t598828 | Library | 362.7059 | 53.2614 | 0 | 0 | 1.702596 | 0.290853 |
| t598836 | Library | 544.9485 | 38.11311 | 0 | 0 | 2.522761 | 0.438238 |
| t598888 | Library | 0 | 0 | 1.036494 | 2.072988 | 0 | 0 |
| t598890 | Library | 216.4236 | 177.1733 | 0 | 0 | 1.067688 | 0.958823 |
| t598897 | Library | 303.5841 | 49.89216 | 0 | 0 | 1.9597 | 0.712481 |
| t598916 | Library | 528.2121 | 40.26965 | 3.166338 | 6.332675 | 2.217625 | 0.308839 |
| t598965 | Library | 259.0065 | 16.53317 | 0 | 0 | 1.82891 | 0.368218 |
| t598976 | Library | 262.3653 | 15.67957 | 0 | 0 | 1.252384 | 0.144212 |
| t599210 | Library | 137.3035 | 10.28164 | 453.0067 | 13.07732 | 0.545126 | 0.127023 |
| t599231 | Library | 575.119 | 59.46478 | 0 | 0 | 2.438902 | 0.437276 |
| t599271 | Library | 644.8095 | 74.40164 | 0 | 0 | 2.902135 | 0.475949 |
| t599285 | Library | 670.6119 | 86.9222 | 0 | 0 | 2.154638 | 0.264646 |

TABLE 9

Results of Secondary Screen of C. Sativa OLS Protein Engineering Library

| Strain | Strain type | Amino Acid mutations from wild-type Cannabis protein (SEQ ID NO: 5) | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t346317 | GFP Negative Ctrl | | 0 | 0 | 0 | 0 |
| t405417 | Library | T335C | 29155.65 | 1352.507 | 925.5075 | 84.12739 |
| t404953 | Library | S334P | 16467.14 | 2021.617 | 473.085 | 68.7974 |
| t405220 | Library | Y153G | 15190.5 | 1885.253 | 437.9325 | 84.3569 |
| t404192 | Library | I284Y | 14380.39 | 1956.468 | 390.18 | 39.47375 |
| t404323 | Library | K100L | 14246.96 | 544.9192 | 456.55 | 35.50002 |
| t404196 | Library | K116R | 14068.84 | 2527.921 | 380.4225 | 42.26844 |
| t404209 | Library | I278E | 13888.94 | 2872.84 | 439.1325 | 66.1486 |
| t404164 | Library | K108D | 13824.77 | 2873.633 | 292.71 | 197.9307 |
| t404170 | Library | L348S | 13625.61 | 1648.021 | 291.5625 | 195.0828 |
| t404384 | Library | K71R | 13619.49 | 3039.582 | 372.775 | 42.82276 |
| t405397 | Library | V92G | 13537.85 | 363.1012 | 414.8725 | 26.8083 |
| t405164 | Library | T128V | 13374.17 | 1328.433 | 385.2925 | 59.52873 |
| t404191 | Library | K100M | 13326.69 | 1006.193 | 280.65 | 188.8515 |
| t405340 | Library | Y135V | 13234.48 | 1441.185 | 393.945 | 57.71197 |
| t404421 | Library | P229A | 13099.17 | 2790.466 | 280.175 | 190.3239 |
| t404631 | Library | L241I | 13096.36 | 2072.187 | 425.4825 | 86.29982 |
| t405133 | Library | T128A | 13050.31 | 1267.354 | 408.1175 | 30.00599 |
| t405081 | Library | T128I | 12839.46 | 770.8077 | 409.595 | 60.20914 |
| t404898 | Library | S334A | 12549.31 | 2014.497 | 392.02 | 20.58724 |
| t405017 | Library | S326R | 12437.99 | 1793.811 | 291.3725 | 198.041 |
| t405140 | Library | A125S | 12379.56 | 2038.247 | 579.6825 | 87.43007 |
| t404276 | Library | I273V | 12341.81 | 673.6841 | 344.5 | 243.9399 |
| t404405 | Library | K51R | 12305.55 | 2024.022 | 401.0325 | 52.97083 |
| t405079 | Library | H328Y | 11965.56 | 636.541 | 380.795 | 28.50397 |
| t404978 | Library | F64Y | 11905.29 | 408.7996 | 208.145 | 241.0289 |
| t405347 | Library | T17K | 11875.39 | 1484.666 | 353.8775 | 41.08276 |
| t404855 | Library | I207L | 11774.75 | 1252.291 | 380.1475 | 30.28471 |
| t405362 | Library | V324I | 11489.89 | 2109.012 | 350.79 | 78.35325 |
| t404523 | Library | L25R | 11375.9 | 2136.219 | 212.6875 | 248.5159 |
| t404951 | Library | T296A | 11266.41 | 958.6764 | 269.73 | 181.7056 |
| t405308 | Library | D320A | 11140.11 | 1318.646 | 346.7825 | 18.1635 |
| t405201 | Library | V307I | 11054.69 | 3152.4 | 194.21 | 241.925 |
| t404219 | Library | I23C | 11046.19 | 1061.09 | 380.345 | 25.59692 |

TABLE 9-continued

Results of Secondary Screen of C. Sativa OLS Protein Engineering Library

| Strain | Strain type | Amino Acid mutations from wild-type Cannabis protein (SEQ ID NO: 5) | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t404673 | Library | M267K | 11004.45 | 2014.531 | 382.22 | 111.9515 |
| t404274 | Library | L277M | 10942.46 | 930.1003 | 360.4375 | 80.2903 |
| t405042 | Library | T123C | 10940.26 | 899.6448 | 314.7975 | 212.1934 |
| t404528 | Library | M267G | 10521.73 | 2186.36 | 260.765 | 189.9513 |
| t405312 | Library | E196K | 10503.49 | 1491.483 | 321.1425 | 43.88772 |
| t404725 | Library | R375T | 10474.14 | 637.7002 | 181.37 | 209.4388 |
| t405303 | Library | T247A | 10412.99 | 1484.527 | 353.6075 | 15.69949 |
| t405395 | Library | V95A | 10397.39 | 1215.177 | 299.155 | 49.56504 |
| t405326 | Library | D54R | 10116.47 | 1327.968 | 316.9625 | 42.33512 |
| t404599 | Library | L201C | 10033.37 | 1349.986 | 368.615 | 82.31389 |

TABLE 10A

Results of Secondary Screen of Protein Engineering Library Using C. sativa, Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t527338 GFP | | | 22.72917 | 79.04841 | 0 | 0 |
| t606794 | Cannabis sativa (Hemp) (Marijuana) | wild-type | 15598.47 | 5507.375 | 337.3906 | 163.6388 |
| t527340 Cannabis OLS | Cannabis sativa | wild-type | 15534.95 | 6243.926 | 359.0063 | 194.9093 |
| t607067 | Cannabis sativa | F367L | 10907.1 | 3397.082 | 310.75 | 114.4806 |
| t607367 | Cannabis sativa | G366A | 8394.975 | 2661.736 | 137.95 | 44.65143 |
| t607391 | Cannabis sativa | P298N | 8381.075 | 1668.07 | 167.15 | 37.8978 |
| t606801 | Cannabis sativa | S334P | 22691 | 2379.928 | 572.025 | 55.64575 |
| t606984 | Cannabis sativa | I248M | 384.975 | 256.6688 | 124.475 | 6.990649 |
| t606899 | Cannabis sativa | S332W | 55.1 | 110.2 | 19.4 | 38.8 |
| t606797 Corchorus OLS | Corchorus olitorius | wild-type | 448.8643 | 190.2768 | 665.7071 | 222.9162 |
| t606807 | Corchorus olitorius | d1-8 Y142C | 8173.95 | 11559.71 | 639.55 | 114.0563 |
| t607179 | Corchorus olitorius | Y301W V302I V303T N305P P308K T309A | 1487.6 | 1289.575 | 528.325 | 51.91142 |
| t607149 | Corchorus olitorius | d1-8 W339S | 925.4 | 1638.079 | 108.825 | 35.84888 |
| t607139 | Corchorus olitorius | d1-8 Y266F | 539.55 | 467.458 | 383.3 | 31.26137 |
| t607112 | Corchorus olitorius | W339S | 517.075 | 737.3064 | 81.225 | 37.55896 |
| t607332 | Corchorus olitorius | d1-8 Y301W V302I V303T N305P P308K T309A | 408.25 | 41.92648 | 393.6 | 66.39794 |
| t607153 | Corchorus olitorius | d1-8 A373G | 334.35 | 19.09633 | 529.5 | 33.9143 |
| t607158 | Corchorus olitorius | A373G | 314.8 | 15.06143 | 423.9 | 57.00158 |

TABLE 10A-continued

Results of Secondary Screen of Protein Engineering Library Using C. sativa,
Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607236 | Corchorus olitorius | M255I | 315.325 | 23.9742 | 360.4 | 7.086607 |
| t607141 | Corchorus olitorius | d1-8 Y266F W339S | 168.575 | 337.15 | 69.325 | 8.448422 |
| t607176 | Corchorus olitorius | L374F | 130.45 | 150.9282 | 97.05 | 6.728298 |
| t606930 | Corchorus olitorius | d1-8 M255I | 265.85 | 306.9972 | 735.6 | 53.30647 |
| t607193 | Corchorus olitorius | d1-8 T12Y F39Y Q42R L43A Q47E Q51D Q57K I77L G79E S84C E96D T100E L121K N123K A135V A137M T139G H143Q N146K K151R H152P K156R F158M S174A V182R D183G S184A N231T K232N I241V T253D C260G M287E M353R Q357E S395N | 65.675 | 131.35 | 39.3 | 28.53571 |
| t607006 | Corchorus olitorius | Y266F | 265.975 | 178.2236 | 505.325 | 21.29575 |
| t606993 | Corchorus olitorius | d1-8 N305P | 165.875 | 191.5369 | 427.15 | 17.27937 |
| t606852 | Corchorus olitorius | N305P | 73.375 | 146.75 | 404.3 | 58.06772 |
| t607119 | Corchorus olitorius | d1-8 L374F | 0 | 0 | 111.725 | 18.69962 |
| t607371 | Corchorus olitorius | Y266F W339S | 0 | 0 | 37.25 | 3.421988 |
| t527346 Cymbidium OLS | Cymbidium hybrid cultivar | wild-type | 29779.86 | 10784.18 | 631.1694 | 320.6464 |
| t606952 | Cymbidium hybrid cultivar | V71Y | 40374.05 | 3947.169 | 1177.275 | 107.3831 |
| t607284 | Cymbidium hybrid cultivar | F70M | 18119.03 | 1257.566 | 374.85 | 15.30109 |
| t607262 | Cymbidium hybrid cultivar | L385M | 18869.45 | 2300.831 | 394.425 | 43.38251 |
| t606938 | Cymbidium hybrid cultivar | D88A | 30129.05 | 421.2235 | 773.1 | 17.39483 |
| t607260 | Cymbidium hybrid cultivar | E285A | 15646.4 | 1341.912 | 319.1 | 21.50364 |
| t607159 | Cymbidium hybrid cultivar | L76I | 25322 | 7151.452 | 633.5 | 130.6911 |

TABLE 10A-continued

Results of Secondary Screen of Protein Engineering Library Using *C. sativa*, Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t606946 | Cymbidium hybrid cultivar | N151P | 29738.73 | 5548.193 | 778.9 | 116.4196 |
| t606861 | Cymbidium hybrid cultivar | E203K | 44399.18 | 12437.5 | 1252.525 | 394.7546 |
| t606918 | Cymbidium hybrid cultivar | V50N | 27251.28 | 1711.322 | 732.125 | 88.38052 |
| t607135 | Cymbidium hybrid cultivar | E28P | 24306.43 | 6961.951 | 615.45 | 163.6961 |
| t607286 | Cymbidium hybrid cultivar | S34Q | 13463.55 | 871.8021 | 287.675 | 21.0191 |
| t606942 | Cymbidium hybrid cultivar | R100P | 34937.75 | 2136.806 | 968.7 | 20.64752 |
| t606959 | Cymbidium hybrid cultivar | A219C | 32778.4 | 1462.567 | 812.475 | 54.31368 |
| t607294 | Cymbidium hybrid cultivar | K359M | 13309.98 | 473.943 | 279 | 10.60157 |
| t607282 | Cymbidium hybrid cultivar | R100T | 13723.58 | 1657.273 | 282.825 | 20.36768 |
| t607230 | Cymbidium hybrid cultivar | E116D | 21772.93 | 983.0294 | 469.875 | 34.1937 |
| t606965 | Cymbidium hybrid cultivar | Y142V | 26443.03 | 1993.229 | 918 | 96.78736 |
| t607288 | Cymbidium hybrid cultivar | T289D | 13669.95 | 750.4718 | 290.775 | 34.8278 |
| t607228 | Cymbidium hybrid cultivar | M135I | 21348.6 | 702.6819 | 604.6 | 19.56238 |
| t606909 | Cymbidium hybrid cultivar | W368H | 40713.38 | 2212.329 | 998.95 | 50.99526 |
| t606962 | Cymbidium hybrid cultivar | D229E | 28238.98 | 1771.039 | 765.65 | 43.92285 |
| t607150 | Cymbidium hybrid cultivar | E285K | 25386.95 | 2387.108 | 593.6 | 71.86895 |
| t607361 | Cymbidium hybrid cultivar | E323Q | 20209.88 | 3057.447 | 378.4 | 72.17622 |
| t606932 | Cymbidium hybrid cultivar | S18T | 26673.38 | 4632.723 | 726.825 | 106.151 |
| t606940 | Cymbidium hybrid cultivar | A13S | 29094.85 | 3024.508 | 737.1 | 40.72935 |
| t607269 | Cymbidium hybrid cultivar | A333R | 12947.23 | 883.2885 | 268.075 | 35.74207 |
| t607186 | Cymbidium hybrid cultivar | S180N | 23191.9 | 4783.221 | 594.2 | 135.8793 |
| t607476 | Cymbidium hybrid cultivar | L20F | 17200 | 1998.783 | 350.375 | 25.15451 |
| t607031 | Cymbidium hybrid cultivar | N80H | 25388.63 | 6003.712 | 611.825 | 130.4566 |
| t606916 | Cymbidium hybrid cultivar | R100A | 25282.83 | 1244.898 | 638.4 | 21.58997 |

TABLE 10A-continued

Results of Secondary Screen of Protein Engineering Library Using *C. sativa*, Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607292 | Cymbidium hybrid cultivar | V331I | 12013.93 | 2802.682 | 241.875 | 58.81765 |
| t606908 | Cymbidium hybrid cultivar | I22M | 32699.68 | 21947.9 | 1120.825 | 82.20671 |
| t607248 | Cymbidium hybrid cultivar | E155C | 20670.43 | 1761.502 | 477.55 | 41.49647 |
| t607023 | Cymbidium hybrid cultivar | V71H | 27924.45 | 1393.419 | 761.2 | 34.79224 |
| t606936 | Cymbidium hybrid cultivar | T111K | 26953.6 | 3174.107 | 689.975 | 120.0151 |
| t607433 | Cymbidium hybrid cultivar | L291V | 18071.78 | 6905.44 | 351.525 | 142.8462 |
| t607600 | Cymbidium hybrid cultivar | R123A | 18038.33 | 2576.146 | 333.575 | 50.84194 |
| t606894 | Cymbidium hybrid cultivar | Y142F | 36097.63 | 2137.695 | 911.05 | 54.27403 |
| t606963 | Cymbidium hybrid cultivar | I147E | 26509.6 | 1811.909 | 657.275 | 14.62882 |
| t607603 | Cymbidium hybrid cultivar | Y142I | 18913.93 | 1120.707 | 596.475 | 92.27106 |
| t607452 | Cymbidium hybrid cultivar | K54E | 16597 | 3291.995 | 329.3 | 60.58185 |
| t607197 | Cymbidium hybrid cultivar | G84C | 19663.7 | 884.8279 | 459.3 | 27.12354 |
| t606996 | Cymbidium hybrid cultivar | T170A | 39067.8 | 2354.185 | 1157.575 | 79.54543 |
| t607043 | Cymbidium hybrid cultivar | N45T | 28747.38 | 934.8057 | 679.875 | 21.52431 |
| t607254 | Cymbidium hybrid cultivar | G262T | 11775.15 | 1040.26 | 246.425 | 18.13861 |
| t607478 | Cymbidium hybrid cultivar | N11R | 15894.55 | 2710.618 | 324.075 | 39.31619 |
| t607132 | Cymbidium hybrid cultivar | D208A | 24881.38 | 1936.584 | 765.75 | 60.52451 |
| t607109 | Cymbidium hybrid cultivar | D61R | 25634.95 | 2078.231 | 613.375 | 100.6135 |
| t607155 | Cymbidium hybrid cultivar | C176D | 22283.45 | 3073.579 | 526.325 | 67.26383 |
| t606956 | Cymbidium hybrid cultivar | L83M | 23728.73 | 2145.982 | 656.075 | 79.72258 |
| t606906 | Cymbidium hybrid cultivar | E28A | 33411.15 | 939.6742 | 850.55 | 34.71894 |
| t607195 | Cymbidium hybrid cultivar | T111R | 17676.68 | 1327.959 | 403.725 | 50.31689 |
| t607449 | Cymbidium hybrid cultivar | E203P | 16032.95 | 2469.127 | 317.75 | 28.30789 |
| t607256 | Cymbidium hybrid cultivar | G373A | 12090.73 | 566.8141 | 281.125 | 10.12073 |

TABLE 10A-continued

Results of Secondary Screen of Protein Engineering Library Using *C. sativa*, Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607349 | Cymbidium hybrid cultivar | K282D | 18699.3 | 3173.399 | 354.175 | 88.50621 |
| t606960 | Cymbidium hybrid cultivar | N78R | 25400.9 | 667.3651 | 660.875 | 37.90764 |
| t607601 | Cymbidium hybrid cultivar | K121V | 18381.8 | 4015.223 | 314.125 | 78.4602 |
| t607021 | Cymbidium hybrid cultivar | H69Y | 24261.93 | 2128.687 | 571.075 | 61.0977 |
| t606874 | Cymbidium hybrid cultivar | D208S | 28092.05 | 2956.394 | 886.05 | 199.1175 |
| t607320 | Cymbidium hybrid cultivar | T111E | 16500.03 | 4257.055 | 303.275 | 77.26765 |
| t607317 | Cymbidium hybrid cultivar | C82E | 17852.45 | 4825.826 | 325.225 | 76.27321 |
| t607224 | Cymbidium hybrid cultivar | Y142C | 19142.53 | 1455.367 | 540.25 | 54.21098 |
| t606912 | Cymbidium hybrid cultivar | D14P | 31141.75 | 1149.49 | 769.2 | 65.33912 |
| t607602 | Cymbidium hybrid cultivar | R100E | 17901.3 | 2319.379 | 328.5 | 67.41187 |
| t606905 | Cymbidium hybrid cultivar | V388A | 29890.83 | 2522.115 | 747.45 | 83.27435 |
| t607156 | Cymbidium hybrid cultivar | H269S | 21143.2 | 1008.997 | 527.5 | 30.55083 |
| t607474 | Cymbidium hybrid cultivar | G262A | 15068.18 | 1372.284 | 326.075 | 28.24894 |
| t607482 | Cymbidium hybrid cultivar | R24K | 14858.45 | 2175.705 | 313.6 | 58.93963 |
| t606854 | Cymbidium hybrid cultivar | L144I | 35182.43 | 2487.935 | 921.625 | 54.02563 |
| t607032 | Cymbidium hybrid cultivar | K355S | 24649.8 | 1675.56 | 544.4 | 16.12203 |
| t606830 | Cymbidium hybrid cultivar | M135V | 34299.15 | 4732.074 | 977.675 | 108.3528 |
| t606961 | Cymbidium hybrid cultivar | V43M | 25357.95 | 678.9486 | 646.975 | 24.3909 |
| t606868 | Cymbidium hybrid cultivar | L248I | 35144.45 | 1993.999 | 945.425 | 66.1703 |
| t607083 | Cymbidium hybrid cultivar | G84S | 21707.73 | 2407.367 | 537.85 | 68.42819 |
| t606958 | Cymbidium hybrid cultivar | C82N | 22576.8 | 2610.997 | 564.75 | 61.60793 |
| t607273 | Cymbidium hybrid cultivar | V341P | 10381.15 | 857.4199 | 209.325 | 25.9962 |
| t607241 | Cymbidium hybrid cultivar | V388T | 17754.23 | 1010.578 | 444.275 | 22.37668 |
| t606857 | Cymbidium hybrid cultivar | A195V | 36686.03 | 2848.052 | 937.825 | 116.369 |

TABLE 10A-continued

Results of Secondary Screen of Protein Engineering Library Using *C. sativa*,
Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t606901 | Cymbidium hybrid cultivar | D208C | 30154 | 1882.794 | 883.325 | 84.4674 |
| t607015 | Cymbidium hybrid cultivar | G84T | 23550.9 | 1835.311 | 559.725 | 25.30183 |
| t607586 | Cymbidium hybrid cultivar | I326R | 13845.4 | 1980.772 | 297.075 | 55.00051 |
| t607122 | Cymbidium hybrid cultivar | F374L | 20425.3 | 2531.711 | 488.175 | 62.87863 |
| t606882 | Cymbidium hybrid cultivar | L222I | 27445.5 | 1536.232 | 692.15 | 54.08453 |
| t607146 | Cymbidium hybrid cultivar | G262T | 18830.75 | 1157.57 | 440.025 | 51.65213 |
| t607585 | Cymbidium hybrid cultivar | L83I | 13348.68 | 1378.214 | 274.425 | 30.01082 |
| t606828 | Cymbidium hybrid cultivar | A107M | 32613.03 | 1865.271 | 860.575 | 52.56104 |
| t607081 | Cymbidium hybrid cultivar | I99G | 20827 | 2377.691 | 521.525 | 35.96761 |
| t606887 | Cymbidium hybrid cultivar | Q274G | 27128.45 | 1010.786 | 675.45 | 25.36697 |
| t606891 | Cymbidium hybrid cultivar | K356Q | 26852.25 | 420.5503 | 655.325 | 41.67072 |
| t607160 | Cymbidium hybrid cultivar | V341A | 19361.23 | 1205.165 | 469.725 | 29.27984 |
| t607194 | Cymbidium hybrid cultivar | F86Y | 17323.08 | 6000.996 | 483.975 | 161.5325 |
| t607377 | Cymbidium hybrid cultivar | S339W | 0 | 0 | 46 | 22.64553 |
| t607265 | Cymbidium hybrid cultivar | E28P F40Y N51D K54E N80H C82E L83I G84C F86Y D88A N89P N92D F97M I99R T111Q R123K L137M I147L N151P C176D S180N K182P Q206L H233N S237F A252E S260G G262A G281E T289K D367E | 5858.45 | 955.8912 | 165.625 | 31.40938 |
| t607000 | Cymbidium hybrid cultivar | G373A F374L | 16989.08 | 11567.45 | 700.525 | 192.4804 |
| t607245 | Cymbidium hybrid cultivar | E28P G84C N89P T111R | 8507.025 | 5710.02 | 210.4 | 141.3894 |

TABLE 10A-continued

Results of Secondary Screen of Protein Engineering Library Using *C. sativa*,
Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| | | N151P C176D Q206L S237F A252E G262T G281E | | | | |
| t607318 | Cymbidium hybrid cultivar | E28P F40Y N51D K54E N80H C82E L83I G84C F86Y D88A N89P N92D F97M I99R T111E R123K L137M I147L N151P C176D S180N K182P Q206L H233N S237F A252E S260G G262A G281E T289K D367E | 6864.125 | 789.6743 | 243.25 | 102.741 |
| t607435 | Cymbidium hybrid cultivar | E28P N51D K54E N80H C82E L83I G84C F86Y D88A N89P N92D F97M I99R T111E R123K L137M I147L N151P C176D S180N K182P Q206L H233N S237F A252E S260G G262A G281E T289K D367E | 4888.425 | 3390.097 | 163.75 | 117.0815 |
| t607337 | Cymbidium hybrid cultivar | E28P N51E N80H C82E L83I G84C F86Y D88A N89P N92D F97M I99R T111R R123K L137M I147L N151P C176D S180N K182P Q206L H233N S237F A252E | 5250.525 | 764.6064 | 135.05 | 26.46186 |

TABLE 10A-continued

Results of Secondary Screen of Protein Engineering Library Using C. sativa,
Cochorus, and Cymbidium Templates (supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607316 | Cymbidium hybrid cultivar | S260G G262A G281E T289K D367E W301Y P303V P305N R308P A309T | 5549.375 | 462.0676 | 169 | 15.9066 |
| t607124 | Cymbidium hybrid cultivar | I255M A266Y W301Y P303V P305N R308P A309T S339W V341P G373A F374L | 0 | 0 | 0 | 0 |
| t607280 | Cymbidium hybrid cultivar | A266Y P305N S339W V341P G373A F374L | 0 | 0 | 0 | 0 |
| t607290 | Cymbidium hybrid cultivar | A266Y S339W | 0 | 0 | 0 | 0 |
| t607381 | Cymbidium hybrid cultivar | A266Y P305N S339W | 0 | 0 | 0 | 0 |

TABLE 10B

Results of Secondary Screen of Protein Engineering Library Using C. sativa,
Cochorus, and Cymbidium Templates (supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_Corchorus OLS (per OD) | Standard Deviation Olivetol Normalized to t606797_Corchorus OLS |
|---|---|---|---|---|---|---|
| t527338 GFP | | | 0.001903 | 0.006512 | | |
| t606794 | Cannabis sativa (Hemp) (Marijuana) | wild-type | 1.166072 | 0.265739 | | |
| t527340 Cannabis OLS | Cannabis sativa | wild-type | 1.02159 | 0.125216 | | |
| t607067 | Cannabis sativa | F367L | 0.761216 | 0.189784 | | |
| t607367 | Cannabis sativa | G366A | 0.745615 | 0.241737 | | |
| t607391 | Cannabis sativa | P298N | 0.708056 | 0.110021 | | |
| t606801 | Cannabis sativa | S334P | 0.674894 | 0.108203 | | |
| t606984 | Cannabis sativa | I248M | 0.00995 | 0.006837 | | |
| t606899 | Cannabis sativa | S332W | 0.001802 | 0.003605 | | |
| t606797 Corchorus OLS | Corchorus olitorius | wild-type | 0.027033 | 0.012052 | 1 | 0.520764 |

TABLE 10B-continued

Results of Secondary Screen of Protein Engineering Library Using C. sativa, Cochorus, and Cymbidium Templates (supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_Corchorus OLS (per OD) | Standard Deviation Olivetol Normalized to t606797_Corchorus OLS |
|---|---|---|---|---|---|---|
| t606807 | Corchorus olitorius | d1-8 Y142C | 0.275531 | 0.38966 | 29.9306 | 42.32826 |
| t607179 | Corchorus olitorius | Y301W V302I V303T N305P P308K T309A | 0.103413 | 0.091496 | 2.842431 | 2.514883 |
| t607149 | Corchorus olitorius | d1-8 W339S | 0.075566 | 0.133268 | 2.077017 | 3.663029 |
| t607139 | Corchorus olitorius | d1-8 Y266F | 0.038008 | 0.033998 | 1.044701 | 0.934465 |
| t607112 | Corchorus olitorius | W339S | 0.033504 | 0.050586 | 1.29632 | 1.957247 |
| t607332 | Corchorus olitorius | d1-8 Y301W V302I V303T N305P P308K T309A | 0.027999 | 0.00441 | 0.919863 | 0.144887 |
| t607153 | Corchorus olitorius | d1-8 A373G | 0.025872 | 0.001554 | 0.711133 | 0.042715 |
| t607158 | Corchorus olitorius | A373G | 0.0221 | 0.001298 | 0.607436 | 0.035688 |
| t607236 | Corchorus olitorius | M255I | 0.019521 | 0.001797 | 0.701647 | 0.064597 |
| t607141 | Corchorus olitorius | d1-8 Y266F W339S | 0.012974 | 0.025949 | 0.356615 | 0.71323 |
| t607176 | Corchorus olitorius | L374F | 0.010369 | 0.012076 | 0.285013 | 0.33193 |
| t606930 | Corchorus olitorius | d1-8 M255I | 0.009039 | 0.010752 | 0.948726 | 1.128513 |
| t607193 | Corchorus olitorius | d1-8 T12Y F39Y Q42R L43A Q47E Q51D Q57K I77L G79E S84C E96D T100E L121K N123K A135V A137M T139G H143Q N146K K151R H152P K156R F158M S174A V182R D183G S184A N231T K232N I241V T253D C260G M287E M353R Q357E S395N | 0.005613 | 0.011226 | 0.154285 | 0.30857 |
| t607006 | Corchorus olitorius | Y266F | 0.004498 | 0.003084 | 0.58364 | 0.400247 |
| t606993 | Corchorus olitorius | d1-8 N305P | 0.003933 | 0.004545 | 0.510385 | 0.58981 |
| t606852 | Corchorus olitorius | N305P | 0.001714 | 0.003429 | 0.186231 | 0.372463 |
| t607119 | Corchorus olitorius | d1-8 L374F | 0 | 0 | 0 | 0 |
| t607371 | Corchorus olitorius | Y266F W339S | 0 | 0 | 0 | 0 |
| t527346 Cymbidium OLS | Cymbidium hybrid cultivar | wild-type | 0.90183 | 0.165441 | | |
| t606952 | Cymbidium hybrid cultivar | V71Y | 0.967928 | 0.215533 | | |
| t607284 | Cymbidium hybrid cultivar | F70M | 0.949145 | 0.075505 | | |
| t607262 | Cymbidium hybrid cultivar | L385M | 0.890722 | 0.082131 | | |
| t606938 | Cymbidium hybrid cultivar | D88A | 0.871 | 0.251207 | | |

TABLE 10B-continued

Results of Secondary Screen of Protein Engineering Library Using C. sativa, Cochorus, and Cymbidium Templates (supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t607260 | Cymbidium hybrid cultivar | E285A | 0.806964 | 0.103286 | | |
| t607159 | Cymbidium hybrid cultivar | L76I | 0.760304 | 0.251978 | | |
| t606946 | Cymbidium hybrid cultivar | N151P | 0.754797 | 0.320899 | | |
| t606861 | Cymbidium hybrid cultivar | E203K | 0.745482 | 0.268545 | | |
| t606918 | Cymbidium hybrid cultivar | V50N | 0.734491 | 0.069332 | | |
| t607135 | Cymbidium hybrid cultivar | E28P | 0.731258 | 0.315887 | | |
| t607286 | Cymbidium hybrid cultivar | S34Q | 0.716576 | 0.071466 | | |
| t606942 | Cymbidium hybrid cultivar | R100P | 0.712487 | 0.038444 | | |
| t606959 | Cymbidium hybrid cultivar | A219C | 0.709144 | 0.063379 | | |
| t607294 | Cymbidium hybrid cultivar | K359M | 0.707812 | 0.023224 | | |
| t607282 | Cymbidium hybrid cultivar | R100T | 0.703105 | 0.073566 | | |
| t607230 | Cymbidium hybrid cultivar | E116D | 0.694814 | 0.046965 | | |
| t606965 | Cymbidium hybrid cultivar | Y142V | 0.690425 | 0.129346 | | |
| t607288 | Cymbidium hybrid cultivar | T289D | 0.68465 | 0.060985 | | |
| t607228 | Cymbidium hybrid cultivar | M135I | 0.682179 | 0.118232 | | |
| t606909 | Cymbidium hybrid cultivar | W368H | 0.676488 | 0.062146 | | |
| t606962 | Cymbidium hybrid cultivar | D229E | 0.675087 | 0.074269 | | |
| t607150 | Cymbidium hybrid cultivar | E285K | 0.664425 | 0.076686 | | |
| t607361 | Cymbidium hybrid cultivar | E323Q | 0.663279 | 0.09616 | | |
| t606932 | Cymbidium hybrid cultivar | S18T | 0.660218 | 0.135435 | | |
| t606940 | Cymbidium hybrid cultivar | A13S | 0.657782 | 0.010521 | | |
| t607269 | Cymbidium hybrid cultivar | A333R | 0.652497 | 0.051357 | | |
| t607186 | Cymbidium hybrid cultivar | S180N | 0.649029 | 0.165224 | | |
| t607476 | Cymbidium hybrid cultivar | L20F | 0.647873 | 0.057907 | | |
| t607031 | Cymbidium hybrid cultivar | N80H | 0.629308 | 0.25658 | | |
| t606916 | Cymbidium hybrid cultivar | R100A | 0.628769 | 0.063422 | | |
| t607292 | Cymbidium hybrid cultivar | V331I | 0.628464 | 0.157777 | | |
| t606908 | Cymbidium hybrid cultivar | I22M | 0.624153 | 0.422076 | | |
| t607248 | Cymbidium hybrid cultivar | E155C | 0.622639 | 0.035079 | | |
| t607023 | Cymbidium hybrid cultivar | V71H | 0.620539 | 0.024017 | | |
| t606936 | Cymbidium hybrid cultivar | T111K | 0.620218 | 0.070587 | | |
| t607433 | Cymbidium hybrid cultivar | L291V | 0.61928 | 0.21641 | | |
| t607600 | Cymbidium hybrid cultivar | R123A | 0.617083 | 0.084619 | | |
| t606894 | Cymbidium hybrid cultivar | Y142F | 0.617067 | 0.042344 | | |
| t606963 | Cymbidium hybrid cultivar | I147E | 0.616751 | 0.065014 | | |

TABLE 10B-continued

Results of Secondary Screen of Protein Engineering Library Using C. sativa, Cochorus, and Cymbidium Templates (supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_Corchorus OLS (per OD) | Standard Deviation Olivetol Normalized to t606797_Corchorus OLS |
|---|---|---|---|---|---|---|
| t607603 | Cymbidium hybrid cultivar | Y142I | 0.615776 | 0.03639 | | |
| t607452 | Cymbidium hybrid cultivar | K54E | 0.609431 | 0.073608 | | |
| t607197 | Cymbidium hybrid cultivar | G84C | 0.607758 | 0.04262 | | |
| t606996 | Cymbidium hybrid cultivar | T170A | 0.606281 | 0.062689 | | |
| t607043 | Cymbidium hybrid cultivar | N45T | 0.601817 | 0.034499 | | |
| t607254 | Cymbidium hybrid cultivar | G262T | 0.599911 | 0.07071 | | |
| t607478 | Cymbidium hybrid cultivar | N11R | 0.593189 | 0.06751 | | |
| t607132 | Cymbidium hybrid cultivar | D208A | 0.592492 | 0.112514 | | |
| t607109 | Cymbidium hybrid cultivar | D61R | 0.591253 | 0.021319 | | |
| t607155 | Cymbidium hybrid cultivar | C176D | 0.589853 | 0.117858 | | |
| t606956 | Cymbidium hybrid cultivar | L83M | 0.588247 | 0.063594 | | |
| t606906 | Cymbidium hybrid cultivar | E28A | 0.588171 | 0.068304 | | |
| t607195 | Cymbidium hybrid cultivar | T111R | 0.587434 | 0.080522 | | |
| t607449 | Cymbidium hybrid cultivar | E203P | 0.583681 | 0.065069 | | |
| t607256 | Cymbidium hybrid cultivar | G373A | 0.582906 | 0.069959 | | |
| t607349 | Cymbidium hybrid cultivar | K282D | 0.581651 | 0.053625 | | |
| t606960 | Cymbidium hybrid cultivar | N78R | 0.571233 | 0.098482 | | |
| t607601 | Cymbidium hybrid cultivar | K121V | 0.569034 | 0.179725 | | |
| t607021 | Cymbidium hybrid cultivar | H69Y | 0.563625 | 0.026338 | | |
| t606874 | Cymbidium hybrid cultivar | D208S | 0.562002 | 0.072513 | | |
| t607320 | Cymbidium hybrid cultivar | T111E | 0.561861 | 0.128738 | | |
| t607317 | Cymbidium hybrid cultivar | C82E | 0.559312 | 0.140085 | | |
| t607224 | Cymbidium hybrid cultivar | Y142C | 0.557739 | 0.033377 | | |
| t606912 | Cymbidium hybrid cultivar | D14P | 0.557253 | 0.024918 | | |
| t607602 | Cymbidium hybrid cultivar | R100E | 0.553566 | 0.029107 | | |
| t606905 | Cymbidium hybrid cultivar | V388A | 0.552755 | 0.038488 | | |
| t607156 | Cymbidium hybrid cultivar | H269S | 0.552698 | 0.060754 | | |
| t607474 | Cymbidium hybrid cultivar | G262A | 0.55226 | 0.080327 | | |
| t607482 | Cymbidium hybrid cultivar | R24K | 0.551229 | 0.059821 | | |
| t606854 | Cymbidium hybrid cultivar | L144I | 0.550953 | 0.054635 | | |
| t607032 | Cymbidium hybrid cultivar | K355S | 0.543176 | 0.043908 | | |
| t606830 | Cymbidium hybrid cultivar | M135V | 0.542887 | 0.080821 | | |
| t606961 | Cymbidium hybrid cultivar | V43M | 0.535062 | 0.061363 | | |
| t606868 | Cymbidium hybrid cultivar | L248I | 0.532705 | 0.006774 | | |
| t607083 | Cymbidium hybrid cultivar | G84S | 0.529811 | 0.024702 | | |

TABLE 10B-continued

Results of Secondary Screen of Protein Engineering Library Using C. sativa,
Cochorus, and Cymbidium Templates (supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t606958 | Cymbidium hybrid cultivar | C82N | 0.525334 | 0.152553 | | |
| t607273 | Cymbidium hybrid cultivar | V341P | 0.522317 | 0.046732 | | |
| t607241 | Cymbidium hybrid cultivar | V388T | 0.519025 | 0.016822 | | |
| t606857 | Cymbidium hybrid cultivar | A195V | 0.518645 | 0.087321 | | |
| t606901 | Cymbidium hybrid cultivar | D208C | 0.51686 | 0.063709 | | |
| t607015 | Cymbidium hybrid cultivar | G84T | 0.515084 | 0.042136 | | |
| t607586 | Cymbidium hybrid cultivar | I326R | 0.514156 | 0.080245 | | |
| t607122 | Cymbidium hybrid cultivar | F374L | 0.513354 | 0.048872 | | |
| t606882 | Cymbidium hybrid cultivar | L222I | 0.510184 | 0.011174 | | |
| t607146 | Cymbidium hybrid cultivar | G262T | 0.506767 | 0.057007 | | |
| t607585 | Cymbidium hybrid cultivar | L83I | 0.506322 | 0.049736 | | |
| t606828 | Cymbidium hybrid cultivar | A107M | 0.505604 | 0.006906 | | |
| t607081 | Cymbidium hybrid cultivar | I99G | 0.504811 | 0.041631 | | |
| t606887 | Cymbidium hybrid cultivar | Q274G | 0.50406 | 0.082289 | | |
| t606891 | Cymbidium hybrid cultivar | K356Q | 0.501544 | 0.043785 | | |
| t607160 | Cymbidium hybrid cultivar | V341A | 0.501469 | 0.056063 | | |
| t607194 | Cymbidium hybrid cultivar | F86Y | 0.500062 | 0.184291 | | |
| t607377 | Cymbidium hybrid cultivar | S339W | 0 | 0 | | |
| t607265 | Cymbidium hybrid cultivar | E28P F40Y N51D K54E N80H C82E L83I G84C F86Y D88A N89P N92D F97M I99R T111Q R123K L137M I147L N151P C176D S180N K182P Q206L H233N S237F A252E S260G G262A G281E T289K D367E | 0.298621 | 0.029421 | | |
| t607000 | Cymbidium hybrid cultivar | G373A F374L | 0.279083 | 0.189883 | | |
| t607245 | Cymbidium hybrid cultivar | E28P G84C N89P T111R N151P C176D Q206L S237F A252E G262T G281E | 0.246285 | 0.179183 | | |
| t607318 | Cymbidium hybrid cultivar | E28P F40Y N51D K54E N80H C82E L83I G84C F86Y D88A N89P N92D F97M I99R T111E R123K L137M I147L N151P C176D | 0.205093 | 0.035905 | | |

TABLE 10B-continued

Results of Secondary Screen of Protein Engineering Library Using C. sativa, Cochorus, and Cymbidium Templates (supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| | | S180N K182P Q206L H233N S237F A252E S260G G262A G281E T289K D367E | | | | |
| t607435 | Cymbidium hybrid cultivar | E28P N51D K54E N80H C82E L83I G84C F86Y D88A N89P N92D F97M I99R T111E R123K L137M I147L N151P C176D S180N K182P Q206L H233N S237F A252E S260G G262A G281E T289K D367E | 0.181914 | 0.136726 | | |
| t607337 | Cymbidium hybrid cultivar | E28P N51E N80H C82E L83I G84C F86Y D88A N89P N92D F97M I99R T111R R123K L137M I147L N151P C176D S180N K182P Q206L H233N S237F A252E S260G G262A G281E T289K D367E | 0.163476 | 0.021163 | | |
| t607316 | Cymbidium hybrid cultivar | W301Y P303V P305N R308P A309T | 0.161295 | 0.013439 | | |
| t607124 | Cymbidium hybrid cultivar | I255M A266Y W301Y P303V P305N R308P A309T S339W V341P G373A F374L | 0 | 0 | | |
| t607280 | Cymbidium hybrid cultivar | A266Y P305N S339W V341P G373A F374L | 0 | 0 | | |
| t607290 | Cymbidium hybrid cultivar | A266Y S339W | 0 | 0 | | |
| t607381 | Cymbidium hybrid cultivar | A266Y P305N S339W | 0 | 0 | | |

TABLE 11A

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t527338 | GFP | | 0.620833 | 3.04145 | 0 | 0 |
| t527340 Cannabis OLS | Cannabis sativa | wild-type | 127.8438 | 14.41426 | 0 | 0 |
| t606801 | Cannabis sativa (Hemp) (Marijuana) | S334P | 220.05 | 20.91355 | 0 | 0 |
| t607067 | Cannabis sativa (Hemp) (Marijuana) | F367L | 160.1 | 15.69777 | 0 | 0 |
| t607367 | Cannabis sativa (Hemp) (Marijuana) | G366A | 142.075 | 3.482695 | 0 | 0 |
| t606794 | Cannabis sativa (Hemp) (Marijuana) | wild-type | 150.8156 | 12.9258 | 0 | 0 |
| t607391 | Cannabis sativa (Hemp) (Marijuana) | P298N | 82.95 | 5.945587 | 0 | 0 |
| t606984 | Cannabis sativa (Hemp) (Marijuana) | I248M | 14.025 | 0.745542 | 0 | 0 |
| t606899 | Cannabis sativa (Hemp) (Marijuana) | S332W | 0 | 0 | 0 | 0 |
| t606797 Corchorus OLS | Corchorus olitorius | wild-type | 39.93571 | 6.066497 | 128.175 | 20.00325 |
| t606807 | Corchorus olitorius | d1-8 Y142C | 170.75 | 207.3944 | 44.3 | 26.72864 |
| t606930 | Corchorus olitorius | d1-8 M255I | 43.925 | 4.811358 | 126.175 | 8.854519 |
| t607179 | Corchorus olitorius | Y301W V302I V303T N305P P308K T309A | 40.725 | 8.259288 | 111.775 | 6.540833 |
| t607332 | Corchorus olitorius | d1-8 Y301W V302I V303T N305P P308K T309A | 43.375 | 4.289814 | 143.675 | 17.99711 |
| t607236 | Corchorus olitorius | M255I | 38.825 | 0.869387 | 101.25 | 4.184495 |
| t607006 | Corchorus olitorius | Y266F | 25.425 | 1.011187 | 84.475 | 1.575595 |
| t606993 | Corchorus olitorius | d1-8 N305P | 24.35 | 1.053565 | 77.375 | 1.817278 |
| t607139 | Corchorus olitorius | d1-8 Y266F | 21.525 | 2.692428 | 62.375 | 2.57083 |
| t607158 | Corchorus olitorius | A373G | 17.725 | 1.705628 | 46.75 | 5.257059 |
| t607153 | Corchorus olitorius | d1-8 A373G | 16.875 | 1.327592 | 51.575 | 2.379601 |
| t606852 | Corchorus olitorius | N305P | 25.675 | 1.613227 | 75.975 | 4.164433 |
| t607112 | Corchorus olitorius | W339S | 0 | 0 | 0 | 0 |
| t607119 | Corchorus olitorius | d1-8 L374F | 0 | 0 | 20.725 | 0.780491 |
| t607141 | Corchorus olitorius | d1-8 Y266F W339S | 0 | 0 | 0 | 0 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607149 | Corchorus olitorius | d1-8 W339S | 0 | 0 | 0 | 0 |
| t607176 | Corchorus olitorius | L374F | 0 | 0 | 17.975 | 0.684957 |
| t607193 | Corchorus olitorius | d1-8 T12Y F39Y Q42R L43A Q47E Q51D Q57K I77L G79E S84C E96D T100E L121K N123K A135V A137M T139G H143Q N146K K151R H152P K156R F158M S174A V182R D183G S184A N231T K232N I241V T253D C260G M287E M353R Q357E S395N | 0 | 0 | 0 | 0 |
| t607371 | Corchorus olitorius | Y266F W339S | 0 | 0 | 0 | 0 |
| t527346 Cymbidium OLS | Cymbidium hybrid cultivar | wild-type | 406.4417 | 80.3967 | 3.658333 | 1.293141 |
| t607221 | Cymbidium hybrid cultivar | N92D | 509.9 | 0 | 6.5 | 0.424264 |
| t607228 | Cymbidium hybrid cultivar | M135I | 524.425 | 26.05281 | 6.825 | 0.861684 |
| t606878 | Cymbidium hybrid cultivar | P303A | 632.95 | 28.30365 | 8.125 | 5.596055 |
| t606986 | Cymbidium hybrid cultivar | E323G | 551.95 | 42.85468 | 8.6 | 1.411855 |
| t606999 | Cymbidium hybrid cultivar | N151P | 508.3 | 23.17873 | 8.4 | 0.365148 |
| t607224 | Cymbidium hybrid cultivar | Y142C | 493.525 | 14.39546 | 7.725 | 0.556028 |
| t606976 | Cymbidium hybrid cultivar | Q274K | 541.475 | 26.72569 | 6.525 | 4.353064 |
| t607241 | Cymbidium hybrid cultivar | V388T | 455.325 | 14.62244 | 5.75 | 0.420317 |
| t607603 | Cymbidium hybrid cultivar | Y142I | 540.975 | 14.56237 | 11.475 | 0.853913 |
| t607222 | Cymbidium hybrid cultivar | N11K | 479.35 | 10.11163 | 6.3 | 0.424264 |

TABLE 11A-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607014 | Cymbidium hybrid cultivar | A287M | 511.8 | 26.34755 | 7.975 | 1.388944 |
| t606994 | Cymbidium hybrid cultivar | T289A | 496.475 | 22.44614 | 8.225 | 0.57373 |
| t606982 | Cymbidium hybrid cultivar | V314I | 546.875 | 39.64899 | 8.9 | 1.177568 |
| t606995 | Cymbidium hybrid cultivar | I147L | 480.9 | 23.94006 | 7.225 | 0.7932 |
| t607007 | Cymbidium hybrid cultivar | G281E | 489.6 | 12.27436 | 8.15 | 0.544671 |
| t607008 | Cymbidium hybrid cultivar | I390Q | 491.625 | 18.42107 | 6.575 | 0.125831 |
| t606965 | Cymbidium hybrid cultivar | Y142V | 570.85 | 25.65599 | 10.1 | 0.547723 |
| t607107 | Cymbidium hybrid cultivar | A79E | 431.575 | 22.92108 | 4.575 | 0.877021 |
| t607194 | Cymbidium hybrid cultivar | F86Y | 437.325 | 4.76891 | 4.875 | 0.727438 |
| t606981 | Cymbidium hybrid cultivar | E96R | 512.85 | 23.07993 | 3.825 | 4.439501 |
| t606979 | Cymbidium hybrid cultivar | E32R | 492 | 40.898 | 6.2 | 1.249 |
| t606975 | Cymbidium hybrid cultivar | K182P | 532.825 | 6.97824 | 7.75 | 0.3 |
| t607230 | Cymbidium hybrid cultivar | E116D | 461.35 | 10.56362 | 5.175 | 0.499166 |
| t607004 | Cymbidium hybrid cultivar | L291Y | 487.475 | 6.717825 | 8.25 | 0.619139 |
| t606996 | Cymbidium hybrid cultivar | T170A | 485.075 | 15.50965 | 8 | 0.559762 |
| t607046 | Cymbidium hybrid cultivar | K359R | 527.9 | 18.45842 | 7.775 | 0.556028 |
| t607043 | Cymbidium hybrid cultivar | N45T | 524.225 | 15.59837 | 6.175 | 1.040433 |
| t607021 | Cymbidium hybrid cultivar | H69Y | 530.025 | 26.2045 | 6.95 | 0.635085 |
| t607109 | Cymbidium hybrid cultivar | D61R | 446.85 | 18.05076 | 5.275 | 0.873212 |
| t607036 | Cymbidium hybrid cultivar | K321E | 521.625 | 5.105797 | 8.05 | 0.331662 |
| t606912 | Cymbidium hybrid cultivar | D14P | 538.775 | 35.94546 | 8.975 | 0.910586 |
| t607602 | Cymbidium hybrid cultivar | R100E | 465.225 | 21.39554 | 5.75 | 0.83865 |
| t607361 | Cymbidium hybrid cultivar | E323Q | 453.35 | 6.413787 | 4.775 | 0.411299 |
| t606882 | Cymbidium hybrid cultivar | L222I | 501.55 | 28.07757 | 7.6 | 0.559762 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t606962 | Cymbidium hybrid cultivar | D229E | 523.325 | 17.80587 | 7.225 | 0.330404 |
| t607150 | Cymbidium hybrid cultivar | E285K | 418.225 | 12.1393 | 4.225 | 0.330404 |
| t607252 | Cymbidium hybrid cultivar | F40Y | 435.9 | 14.81486 | 5.275 | 0.713559 |
| t607225 | Cymbidium hybrid cultivar | S260G | 418.925 | 13.55221 | 4.175 | 0.170783 |
| t607032 | Cymbidium hybrid cultivar | K355S | 500.8 | 16.68772 | 6.75 | 1.767767 |
| t607248 | Cymbidium hybrid cultivar | E155C | 405.15 | 11.08708 | 3.3 | 1.036018 |
| t607155 | Cymbidium hybrid cultivar | C176D | 423 | 7.037045 | 4.475 | 0.095743 |
| t606958 | Cymbidium hybrid cultivar | C82N | 536.2 | 25.07761 | 7.575 | 0.634429 |
| t607023 | Cymbidium hybrid cultivar | V71H | 511.725 | 10.15755 | 7 | 0.216025 |
| t607027 | Cymbidium hybrid cultivar | T289K | 520.675 | 13.61503 | 8.1 | 0.535413 |
| t606892 | Cymbidium hybrid cultivar | Y142T | 572.6 | 39.21003 | 10.9 | 0.702377 |
| t607035 | Cymbidium hybrid cultivar | Y160G | 513.55 | 23.95308 | 11.825 | 0.93586 |
| t607237 | Cymbidium hybrid cultivar | T289S | 424.05 | 16.8777 | 4.45 | 0.556776 |
| t607189 | Cymbidium hybrid cultivar | N51E | 420 | 11.2116 | 4.55 | 0.619139 |
| t607118 | Cymbidium hybrid cultivar | T289Q | 404.3 | 9.899495 | 4.25 | 0.070711 |
| t607018 | Cymbidium hybrid cultivar | I390N | 493.25 | 17.93813 | 7.025 | 1.297112 |
| t607045 | Cymbidium hybrid cultivar | F30C | 522.175 | 29.45996 | 8 | 0.930949 |
| t606888 | Cymbidium hybrid cultivar | A107L | 521.125 | 20.05731 | 6.85 | 0.404145 |
| t607220 | Cymbidium hybrid cultivar | A13T | 432.725 | 9.603602 | 4.825 | 0.206155 |
| t606830 | Cymbidium hybrid cultivar | M135V | 568.425 | 18.5615 | 7.6 | 0.432049 |
| t606832 | Cymbidium hybrid cultivar | E155Q | 552.975 | 20.81688 | 7.225 | 0.741058 |
| t607601 | Cymbidium hybrid cultivar | K121V | 429.25 | 19.20772 | 5.025 | 0.15 |
| t606857 | Cymbidium hybrid cultivar | A195V | 607.575 | 22.90988 | 8.125 | 0.567891 |
| t607452 | Cymbidium hybrid cultivar | K54E | 436.75 | 12.72962 | 5.325 | 0.623832 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607218 | Cymbidium hybrid cultivar | F97M | 451.85 | 12.7291 | 5 | 0.787401 |
| t607186 | Cymbidium hybrid cultivar | S180N | 435.525 | 20.91274 | 4.8 | 0.535413 |
| t607123 | Cymbidium hybrid cultivar | S237F | 421.475 | 3.484609 | 4.875 | 0.386221 |
| t607286 | Cymbidium hybrid cultivar | S34Q | 452.15 | 17.4135 | 5.35 | 0.412311 |
| t606918 | Cymbidium hybrid cultivar | V50N | 506.275 | 26.08453 | 6.5 | 0.752773 |
| t606916 | Cymbidium hybrid cultivar | R100A | 509.775 | 27.51986 | 7.05 | 0.988264 |
| t606990 | Cymbidium hybrid cultivar | L291W | 457.875 | 21.00831 | 6.925 | 1.001249 |
| t606908 | Cymbidium hybrid cultivar | I22M | 523.45 | 43.08074 | 4.35 | 5.05536 |
| t606963 | Cymbidium hybrid cultivar | I147E | 502.075 | 20.19032 | 6.4 | 0.752773 |
| t607226 | Cymbidium hybrid cultivar | Q115D | 435.7 | 13.37934 | 5.125 | 0.359398 |
| t606961 | Cymbidium hybrid cultivar | V43M | 537.45 | 13.96675 | 6.8 | 0.355903 |
| t607260 | Cymbidium hybrid cultivar | E285A | 454.15 | 7.783101 | 5.2 | 0.244949 |
| t607160 | Cymbidium hybrid cultivar | V341A | 405.65 | 13.91893 | 4.4 | 0.541603 |
| t607156 | Cymbidium hybrid cultivar | H269S | 415.35 | 17.57546 | 3.925 | 0.464579 |
| t607478 | Cymbidium hybrid cultivar | N11R | 448.1 | 9.988994 | 5.05 | 0.772442 |
| t606887 | Cymbidium hybrid cultivar | Q274G | 481.45 | 22.29716 | 5.7 | 3.81663 |
| t606861 | Cymbidium hybrid cultivar | E203K | 594.35 | 17.56407 | 8.25 | 0.82664 |
| t607217 | Cymbidium hybrid cultivar | D367E | 421.1 | 11.77427 | 4.375 | 0.805709 |
| t606894 | Cymbidium hybrid cultivar | Y142F | 512.875 | 39.92705 | 7.9 | 0.752773 |
| t607288 | Cymbidium hybrid cultivar | T289D | 447.875 | 12.13875 | 4.8 | 0.547723 |
| t606952 | Cymbidium hybrid cultivar | V71Y | 514.9 | 31.88239 | 5.225 | 3.545302 |
| t607197 | Cymbidium hybrid cultivar | G84C | 444.2 | 14.33806 | 4.825 | 0.262996 |
| t607146 | Cymbidium hybrid cultivar | G262T | 399.375 | 11.43864 | 3.925 | 0.394757 |
| t607017 | Cymbidium hybrid cultivar | N78E | 517.475 | 8.940311 | 8.9 | 1.75119 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607456 | Cymbidium hybrid cultivar | T111Q | 466.95 | 34.97175 | 5.375 | 0.512348 |
| t606854 | Cymbidium hybrid cultivar | L144I | 581.275 | 44.29946 | 5.925 | 4.19871 |
| t606838 | Cymbidium hybrid cultivar | R123N | 529.65 | 7.364102 | 6.85 | 0.896289 |
| t607213 | Cymbidium hybrid cultivar | T289G | 416.8 | 8.30542 | 4.375 | 0.531507 |
| t606932 | Cymbidium hybrid cultivar | S18T | 495.975 | 39.19034 | 6.075 | 1.189888 |
| t607349 | Cymbidium hybrid cultivar | K282D | 419.1 | 9.083685 | 4.075 | 0.419325 |
| t607585 | Cymbidium hybrid cultivar | L83I | 450.375 | 20.91226 | 5.175 | 0.287228 |
| t606956 | Cymbidium hybrid cultivar | L83M | 475.55 | 9.733276 | 6.3 | 0.535413 |
| t607586 | Cymbidium hybrid cultivar | I326R | 443.525 | 14.63361 | 5.025 | 0.330404 |
| t607025 | Cymbidium hybrid cultivar | I99T | 473.65 | 23.0925 | 6.4 | 0.408248 |
| t607322 | Cymbidium hybrid cultivar | R123K | 425.975 | 8.165935 | 4.6 | 0.616441 |
| t606905 | Cymbidium hybrid cultivar | V388A | 489.825 | 32.71823 | 6.075 | 4.224827 |
| t606835 | Cymbidium hybrid cultivar | Q161F | 562.35 | 16.93999 | 4.05 | 2.763452 |
| t607104 | Cymbidium hybrid cultivar | E323H | 406.55 | 15.15443 | 4.85 | 0.74162 |
| t607135 | Cymbidium hybrid cultivar | E28P | 392.8 | 21.08159 | 4.05 | 0.789515 |
| t606891 | Cymbidium hybrid cultivar | K356Q | 484.225 | 22.33762 | 7.45 | 0.660808 |
| t607031 | Cymbidium hybrid cultivar | N80H | 508.1 | 14.36825 | 7.05 | 0.613732 |
| t607317 | Cymbidium hybrid cultivar | C82E | 472.45 | 13.27466 | 6.4 | 0.909212 |
| t607088 | Cymbidium hybrid cultivar | P303V | 402.225 | 18.42487 | 3.225 | 0.826136 |
| t607262 | Cymbidium hybrid cultivar | L385M | 467.625 | 36.03085 | 4.5 | 1.048809 |
| t606896 | Cymbidium hybrid cultivar | Q115S | 500.675 | 15.10968 | 6.15 | 4.194043 |
| t607269 | Cymbidium hybrid cultivar | A333R | 455.775 | 3.975236 | 5.15 | 0.597216 |
| t607294 | Cymbidium hybrid cultivar | K359M | 441.65 | 4.773887 | 5.125 | 0.25 |
| t607344 | Cymbidium hybrid cultivar | A252E | 421.125 | 19.75135 | 4.675 | 0.670199 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607159 | Cymbidium hybrid cultivar | L76I | 411.4 | 24.21955 | 4.05 | 0.660808 |
| t606890 | Cymbidium hybrid cultivar | K112R | 519.575 | 20.66985 | 8.55 | 0.675771 |
| t607284 | Cymbidium hybrid cultivar | F70M | 422.125 | 9.036731 | 3.925 | 0.419325 |
| t607292 | Cymbidium hybrid cultivar | V331I | 439.375 | 22.82475 | 4.825 | 0.618466 |
| t607476 | Cymbidium hybrid cultivar | L20F | 438.925 | 17.62978 | 4.075 | 0.464579 |
| t606946 | Cymbidium hybrid cultivar | N151P | 484.525 | 10.50599 | 5.875 | 0.699405 |
| t607320 | Cymbidium hybrid cultivar | T111E | 427.525 | 18.14412 | 5.55 | 1.021437 |
| t607083 | Cymbidium hybrid cultivar | G84S | 379.5 | 14.5952 | 4.175 | 1.284199 |
| t607480 | Cymbidium hybrid cultivar | A13V | 437.5 | 12.94656 | 4.85 | 0.759386 |
| t606909 | Cymbidium hybrid cultivar | W368H | 496.825 | 40.68967 | 4.975 | 3.350995 |
| t607449 | Cymbidium hybrid cultivar | E203P | 433.675 | 17.36613 | 4.35 | 0.331662 |
| t606851 | Cymbidium hybrid cultivar | I293V | 514.65 | 43.13626 | 6.35 | 1.369915 |
| t607079 | Cymbidium hybrid cultivar | S34E | 466.325 | 54.18348 | 7.175 | 1.25 |
| t607282 | Cymbidium hybrid cultivar | R100T | 433.175 | 10.15099 | 4.525 | 0.655108 |
| t606967 | Cymbidium hybrid cultivar | M135A | 446.85 | 27.16143 | 2.8 | 3.237283 |
| t606938 | Cymbidium hybrid cultivar | D88A | 483.9 | 1.131371 | 6.05 | 0.070711 |
| t607433 | Cymbidium hybrid cultivar | L291V | 424.875 | 12.5492 | 4.475 | 0.394757 |
| t607357 | Cymbidium hybrid cultivar | T243A | 419.45 | 12.8108 | 4.5 | 0.294392 |
| t607122 | Cymbidium hybrid cultivar | F374L | 381.9 | 18.88686 | 2.9 | 0.678233 |
| t607110 | Cymbidium hybrid cultivar | R317T | 374.025 | 4.807199 | 3.575 | 0.221736 |
| t607015 | Cymbidium hybrid cultivar | G84T | 514.575 | 14.52111 | 7.575 | 1.367175 |
| t607087 | Cymbidium hybrid cultivar | E96A | 393.975 | 20.30195 | 4.375 | 1.004573 |
| t607019 | Cymbidium hybrid cultivar | I99A | 462.175 | 18.38104 | 6.175 | 0.543906 |
| t606839 | Cymbidium hybrid cultivar | D207S | 557.425 | 29.43245 | 7.425 | 0.818026 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t606942 | Cymbidium hybrid cultivar | R100P | 461.85 | 7.707464 | 4.05 | 0.212132 |
| t607164 | Cymbidium hybrid cultivar | V327A | 393.05 | 14.87672 | 3.225 | 0.35 |
| t606906 | Cymbidium hybrid cultivar | E28A | 482 | 14.14214 | 6.85 | 0.494975 |
| t606868 | Cymbidium hybrid cultivar | L248I | 555.5 | 18.09586 | 9 | 0.955685 |
| t607089 | Cymbidium hybrid cultivar | L77I | 380.525 | 6.542871 | 4.125 | 1.170114 |
| t606910 | Cymbidium hybrid cultivar | N89P | 471.825 | 23.09998 | 7.025 | 1.611159 |
| t606936 | Cymbidium hybrid cultivar | T111K | 468.95 | 8.328465 | 5.125 | 0.287228 |
| t606856 | Cymbidium hybrid cultivar | V157T | 551.4 | 18.24573 | 8.525 | 0.78475 |
| t607450 | Cymbidium hybrid cultivar | I99R | 406.45 | 13.84786 | 3.5 | 0.637704 |
| t606960 | Cymbidium hybrid cultivar | N78R | 456.45 | 26.30089 | 4.225 | 3.001527 |
| t607600 | Cymbidium hybrid cultivar | R123A | 413.025 | 13.12945 | 4.675 | 0.457347 |
| t606940 | Cymbidium hybrid cultivar | A13S | 481.65 | 28.77925 | 6.3 | 0.424264 |
| t607085 | Cymbidium hybrid cultivar | K55R | 349.1 | 16.14745 | 3.125 | 0.543906 |
| t607474 | Cymbidium hybrid cultivar | G262A | 397.225 | 2.348581 | 3.4 | 0.294392 |
| t606959 | Cymbidium hybrid cultivar | A219C | 411.275 | 14.18506 | 2.25 | 0.544671 |
| t606859 | Cymbidium hybrid cultivar | I99E | 511.05 | 22.442 | 7.325 | 0.543906 |
| t606904 | Cymbidium hybrid cultivar | S10R | 467.15 | 52.82088 | 7.25 | 1.626346 |
| t607195 | Cymbidium hybrid cultivar | T111R | 404.8 | 17.43885 | 4.25 | 0.493288 |
| t607445 | Cymbidium hybrid cultivar | P305N | 341.875 | 14.41281 | 2.725 | 0.55 |
| t607273 | Cymbidium hybrid cultivar | V341P | 395.325 | 9.541619 | 3.625 | 0.655108 |
| t606834 | Cymbidium hybrid cultivar | V157I | 516.05 | 31.53966 | 6.625 | 1.192686 |
| t607254 | Cymbidium hybrid cultivar | G262T | 418.575 | 14.71991 | 4.35 | 0.574456 |
| t606828 | Cymbidium hybrid cultivar | A107M | 503.3 | 16.92986 | 5.5 | 1.191638 |
| t606836 | Cymbidium hybrid cultivar | K104Q | 543.5 | 39.43129 | 7.1 | 1.174734 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607081 | Cymbidium hybrid cultivar | I99G | 347.025 | 12.30864 | 2.725 | 0.567891 |
| t607482 | Cymbidium hybrid cultivar | R24K | 405.575 | 10.66908 | 4.175 | 0.434933 |
| t607132 | Cymbidium hybrid cultivar | D208A | 328.9 | 30.48748 | 2.675 | 0.634429 |
| t606874 | Cymbidium hybrid cultivar | D208S | 395.55 | 19.92327 | 4.2 | 0.6733 |
| t607190 | Cymbidium hybrid cultivar | L137M | 292.8 | 8.173942 | 1.5 | 0.216025 |
| t607028 | Cymbidium hybrid cultivar | D208N | 356.3 | 20.88349 | 3.125 | 0.377492 |
| t607370 | Cymbidium hybrid cultivar | L264F | 297.2 | 7.708869 | 4.575 | 0.411299 |
| t606898 | Cymbidium hybrid cultivar | I102A | 371.3 | 14.25669 | 2.75 | 0.834666 |
| t607216 | Cymbidium hybrid cultivar | Q206L | 280.95 | 22.84637 | 2.325 | 0.359398 |
| t606901 | Cymbidium hybrid cultivar | D208C | 351.525 | 23.67324 | 1.8 | 1.275408 |
| t607256 | Cymbidium hybrid cultivar | G373A | 236.425 | 5.235376 | 0 | 0 |
| t607131 | Cymbidium hybrid cultivar | N51D | 191.275 | 227.01 | 1.9 | 2.941655 |
| t607604 | Cymbidium hybrid cultivar | I99K | 203.675 | 235.3296 | 2.225 | |
| t606914 | Cymbidium hybrid cultivar | A13N | 246.7 | 285.4356 | 3.825 | 4.470925 |
| t606934 | Cymbidium hybrid cultivar | S10N | 230.525 | 266.3877 | 2.975 | 3.435477 |
| t607312 | Cymbidium hybrid cultivar | I255M | 60.1 | 3.31763 | 0 | 0 |
| t607377 | Cymbidium hybrid cultivar | S339W | 0 | 0 | 0 | 0 |
| t607318 | Cymbidium hybrid cultivar | E28P F40Y N51D K54E N8OH C82E L83I G84C F86Y D88A N89P N92D F97M I99R T111E R123K L137M I147L N151P C176D S180N K182P Q206L H233N S237F A252E S260G G262A G281E | 260.2 | 9.255269 | 3.3 | 0.702377 |

TABLE 11A-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| t607245 | Cymbidium hybrid cultivar | T289K D367E E28P G84C N89P T111R N151P C176D Q206L S237F A252E G262T G281E | 265.1 | 7.813237 | 0.225 | 0.45 |
| t607000 | Cymbidium hybrid cultivar | G373A F374L | 253.05 | 22.66282 | 0 | 0 |
| t607337 | Cymbidium hybrid cultivar | E28P N51E N80H C82E L83I G84C F86Y D88A N89P N92D F97M I99R T111R R123K L137M I147L N151P C176D S180N K182P Q206L H233N S237F A252E S260G G262A G281E T289K D367E | 214.225 | 6.286162 | 1.6 | 0.141421 |
| t607265 | Cymbidium hybrid cultivar | E28P F40Y N51D K54E N80H C82E L83I G84C F86Y D88A N89P N92D F97M I99R T111Q R123K L137M I147L N151P C176D S180N K182P Q206L H233N S237F A252E S260G G262A G281E T289K D367E | 225.35 | 4.919011 | 1.8 | 0.374166 |
| t607316 | Cymbidium hybrid cultivar | W301Y P303V P305N R308P A309T | 177.7 | 14.90526 | 2.075 | 0.801561 |
| t607435 | Cymbidium hybrid cultivar | E28P N51D K54E N80H C82E L83I G84C F86Y D88A N89P N92D F97M I99R T111E R123K | 156.525 | 104.7564 | 1.075 | 0.813941 |

TABLE 11A-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Olivetol [ug/L] | Standard Deviation Olivetol [ug/L] | Average Olivetolic Acid [ug/L] | Standard Deviation Olivetolic Acid [ug/L] |
|---|---|---|---|---|---|---|
| | | L137M | | | | |
| | | I147L N151P | | | | |
| | | C176D | | | | |
| | | S180N | | | | |
| | | K182P | | | | |
| | | Q206L | | | | |
| | | H233N | | | | |
| | | S237F | | | | |
| | | A252E | | | | |
| | | S260G | | | | |
| | | G262A | | | | |
| | | G281E | | | | |
| | | T289K | | | | |
| | | D367E | | | | |
| t607381 | Cymbidium hybrid cultivar | A266Y P305N S339W | 4.825 | 9.65 | 0 | 0 |
| t607124 | Cymbidium hybrid cultivar | I255M A266Y W301Y P303V P305N R308P A309T S339W V341P G373A F374L | 3.625 | 7.25 | 0 | 0 |
| t607280 | Cymbidium hybrid cultivar | A266Y P305N S339W V341P G373A F374L | 0 | 0 | 0 | 0 |
| t607290 | Cymbidium hybrid cultivar | A266Y S339W | 0 | 0 | 0 | 0 |

TABLE 11B

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t527338 GFP | | | 0.0048 | 0.0235 | | |
| t527340 Cannabis OLS | Cannabis sativa | wild-type | 1.05197 | 0.13292 | | |
| t606801 | Cannabis sativa | S334P | 1.9025 | 0.12934 | | |
| t607067 | Cannabis sativa | F367L | 1.49374 | 0.07849 | | |
| t607367 | Cannabis sativa) | G366A | 1.32919 | 0.09047 | | |
| t606794 | Cannabis sativa (Hemp) (Marijuana) | wild-type | 1.30342 | 0.19421 | | |
| t607391 | Cannabis sativa | P298N | 0.8132 | 0.03261 | | |
| t606984 | Cannabis sativa | I248M | 0.15063 | 0.02208 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t606899 | Cannabis sativa | S332W | 0 | 0 | | |
| t606797 Corchorus OLS | Corchorus olitorius | wild-type | 0.31178 | 0.05119 | 1 | 0.14396 |
| t606807 | Corchorus olitorius | d1-8 Y142C | 1.36312 | 1.64905 | 5.49321 | 6.64551 |
| t606930 | Corchorus olitorius | d1-8 M255I | 0.44815 | 0.04224 | 1.40843 | 0.13275 |
| t607179 | Corchorus olitorius | Y301W V302I V303T N305P P308K T309A | 0.42428 | 0.08973 | 1.45657 | 0.30806 |
| t607332 | Corchorus olitorius | d1-8 Y301W V302I V303T N305P P308K T309A | 0.39884 | 0.06665 | 1.15654 | 0.19327 |
| t607236 | Corchorus olitorius | M255I | 0.37718 | 0.03147 | 1.27535 | 0.1064 |
| t607006 | Corchorus olitorius | Y266F | 0.2237 | 0.00789 | 0.72435 | 0.02554 |
| t606993 | Corchorus olitorius | d1-8 N305P | 0.20738 | 0.02797 | 0.67149 | 0.09057 |
| t607139 | Corchorus olitorius | d1-8 Y266F | 0.19496 | 0.02599 | 0.66932 | 0.08921 |
| t607158 | Corchorus olitorius | A373G | 0.18139 | 0.0179 | 0.62271 | 0.06145 |
| t607153 | Corchorus olitorius | d1-8 A373G | 0.16382 | 0.01353 | 0.56242 | 0.04646 |
| t606852 | Corchorus olitorius | N305P | 0.16244 | 0.00836 | 0.65462 | 0.03369 |
| t607112 | Corchorus olitorius | W339S | 0 | 0 | 0 | 0 |
| t607119 | Corchorus olitorius | d1-8 L374F | 0 | 0 | 0 | 0 |
| t607141 | Corchorus olitorius | d1-8 Y266F W339S | 0 | 0 | 0 | 0 |
| t607149 | Corchorus olitorius | d1-8 W339S | 0 | 0 | 0 | 0 |
| t607176 | Corchorus olitorius | L374F | 0 | 0 | 0 | 0 |
| t607193 | Corchorus olitorius | d1-8 T12Y F39Y Q42R L43A Q47E Q51D Q57K I77L G79E S84C E96D T100E L121K N123K A135V A137M T139G H143Q N146K K151R H152P K156R F158M S174A V182R D183G S184A N231T K232N I241V | 0 | 0 | 0 | 0 |

TABLE 11B-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_Corchorus OLS (per OD) | Standard Deviation Olivetol Normalized to t606797_Corchorus OLS |
|---|---|---|---|---|---|---|
| t607371 | Corchorus olitorius | T253D C260G M287E M353R Q357E S395N Y266F W339S | 0 | 0 | 0 | 0 |
| t527346 Cymbidium OLS | Cymbidium hybrid cultivar | wild-type | 1.02322 | 0.20846 | | |
| t607221 | Cymbidium hybrid cultivar | N92D | 1.67744 | 0.07244 | | |
| t607228 | Cymbidium hybrid cultivar | M135I | 1.64252 | 0.01538 | | |
| t606878 | Cymbidium hybrid cultivar | P303A | 1.56942 | 0.06675 | | |
| t606986 | Cymbidium hybrid cultivar | E323G | 1.56671 | 0.16314 | | |
| t606999 | Cymbidium hybrid cultivar | N151P | 1.5521 | 0.09794 | | |
| t607224 | Cymbidium hybrid cultivar | Y142C | 1.54592 | 0.10755 | | |
| t606976 | Cymbidium hybrid cultivar | Q274K | 1.54274 | 0.07232 | | |
| t607241 | Cymbidium hybrid cultivar | V388T | 1.53854 | 0.07404 | | |
| t607603 | Cymbidium hybrid cultivar | Y142I | 1.53604 | 0.11347 | | |
| t607222 | Cymbidium hybrid cultivar | N11K | 1.52325 | 0.04008 | | |
| t607014 | Cymbidium hybrid cultivar | A287M | 1.49053 | 0.07415 | | |
| t606994 | Cymbidium hybrid cultivar | T289A | 1.46316 | 0.12925 | | |
| t606982 | Cymbidium hybrid cultivar | V314I | 1.46045 | 0.08295 | | |
| t606995 | Cymbidium hybrid cultivar | I147L | 1.4549 | 0.07909 | | |
| t607007 | Cymbidium hybrid cultivar | G281E | 1.45405 | 0.06194 | | |
| t607008 | Cymbidium hybrid cultivar | I390Q | 1.45278 | 0.0047 | | |
| t606965 | Cymbidium hybrid cultivar | Y142V | 1.42708 | 0.18261 | | |
| t607107 | Cymbidium hybrid cultivar | A79E | 1.4258 | 0.07329 | | |
| t607194 | Cymbidium hybrid cultivar | F86Y | 1.42238 | 0.02094 | | |

TABLE 11B-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t606981 | Cymbidium hybrid cultivar | E96R | 1.42122 | 0.04842 | | |
| t606979 | Cymbidium hybrid cultivar | E32R | 1.416 | 0.12096 | | |
| t606975 | Cymbidium hybrid cultivar | K182P | 1.4052 | 0.03345 | | |
| t607230 | Cymbidium hybrid cultivar | E116D | 1.40132 | 0.0774 | | |
| t607004 | Cymbidium hybrid cultivar | L291Y | 1.40103 | 0.06311 | | |
| t606996 | Cymbidium hybrid cultivar | T170A | 1.38574 | 0.05793 | | |
| t607046 | Cymbidium hybrid cultivar | K359R | 1.38299 | 0.01508 | | |
| t607043 | Cymbidium hybrid cultivar | N45T | 1.38195 | 0.03083 | | |
| t607021 | Cymbidium hybrid cultivar | H69Y | 1.37598 | 0.10301 | | |
| t607109 | Cymbidium hybrid cultivar | D61R | 1.37011 | 0.10414 | | |
| t607036 | Cymbidium hybrid cultivar | K321E | 1.36745 | 0.04988 | | |
| t606912 | Cymbidium hybrid cultivar | D14P | 1.36318 | 0.09371 | | |
| t607602 | Cymbidium hybrid cultivar | R100E | 1.35489 | 0.07769 | | |
| t607361 | Cymbidium hybrid cultivar | E323Q | 1.35416 | 0.07809 | | |
| t606882 | Cymbidium hybrid cultivar | L222I | 1.35377 | 0.07907 | | |
| t606962 | Cymbidium hybrid cultivar | D229E | 1.34991 | 0.03688 | | |
| t607150 | Cymbidium hybrid cultivar | E285K | 1.3445 | 0.07571 | | |
| t607252 | Cymbidium hybrid cultivar | F40Y | 1.34329 | 0.11563 | | |
| t607225 | Cymbidium hybrid cultivar | S260G | 1.34171 | 0.08715 | | |
| t607032 | Cymbidium hybrid cultivar | K355S | 1.34146 | 0.08572 | | |
| t607248 | Cymbidium hybrid cultivar | E155C | 1.3346 | 0.03904 | | |
| t607155 | Cymbidium hybrid cultivar | C176D | 1.33173 | 0.01853 | | |
| t606958 | Cymbidium hybrid cultivar | C82N | 1.32771 | 0.01591 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_Corchorus OLS (per OD) | Standard Deviation Olivetol Normalized to t606797_Corchorus OLS |
|---|---|---|---|---|---|---|
| t607023 | Cymbidium hybrid cultivar | V71H | 1.32703 | 0.0343 | | |
| t607027 | Cymbidium hybrid cultivar | T289K | 1.32433 | 0.08328 | | |
| t606892 | Cymbidium hybrid cultivar | Y142T | 1.31787 | 0.21329 | | |
| t607035 | Cymbidium hybrid cultivar | Y160G | 1.31694 | 0.07538 | | |
| t607237 | Cymbidium hybrid cultivar | T289S | 1.31692 | 0.10049 | | |
| t607189 | Cymbidium hybrid cultivar | N51E | 1.31519 | 0.10593 | | |
| t607118 | Cymbidium hybrid cultivar | T289Q | 1.31279 | 0.05154 | | |
| t607018 | Cymbidium hybrid cultivar | I390N | 1.31146 | 0.00884 | | |
| t607045 | Cymbidium hybrid cultivar | F30C | 1.31145 | 0.13007 | | |
| t606888 | Cymbidium hybrid cultivar | A107L | 1.31126 | 0.05185 | | |
| t607220 | Cymbidium hybrid cultivar | A13T | 1.3073 | 0.0685 | | |
| t606830 | Cymbidium hybrid cultivar | M135V | 1.30213 | 0.13463 | | |
| t606832 | Cymbidium hybrid cultivar | E155Q | 1.29883 | 0.18596 | | |
| t607601 | Cymbidium hybrid cultivar | K121V | 1.29806 | 0.0748 | | |
| t606857 | Cymbidium hybrid cultivar | A195V | 1.29426 | 0.3015 | | |
| t607452 | Cymbidium hybrid cultivar | K54E | 1.29134 | 0.03462 | | |
| t607218 | Cymbidium hybrid cultivar | F97M | 1.29082 | 0.07837 | | |
| t607186 | Cymbidium hybrid cultivar | S180N | 1.28937 | 0.10055 | | |
| t607123 | Cymbidium hybrid cultivar | S237F | 1.28824 | 0.07181 | | |
| t607286 | Cymbidium hybrid cultivar | S34Q | 1.28672 | 0.12162 | | |
| t606918 | Cymbidium hybrid cultivar | V50N | 1.28475 | 0.02954 | | |
| t606916 | Cymbidium hybrid cultivar | R100A | 1.28388 | 0.03268 | | |
| t606990 | Cymbidium hybrid cultivar | L291W | 1.27925 | 0.06685 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t606908 | Cymbidium hybrid cultivar | I22M | 1.27921 | 0.08525 | | |
| t606963 | Cymbidium hybrid cultivar | I147E | 1.27917 | 0.09902 | | |
| t607226 | Cymbidium hybrid cultivar | Q115D | 1.27909 | 0.05228 | | |
| t606961 | Cymbidium hybrid cultivar | V43M | 1.27574 | 0.04471 | | |
| t607260 | Cymbidium hybrid cultivar | E285A | 1.27099 | 0.05173 | | |
| t607160 | Cymbidium hybrid cultivar | V341A | 1.26952 | 0.05458 | | |
| t607156 | Cymbidium hybrid cultivar | H269S | 1.26921 | 0.0896 | | |
| t607478 | Cymbidium hybrid cultivar | N11R | 1.26856 | 0.08255 | | |
| t606887 | Cymbidium hybrid cultivar | Q274G | 1.26839 | 0.09424 | | |
| t606861 | Cymbidium hybrid cultivar | E203K | 1.26653 | 0.2508 | | |
| t607217 | Cymbidium hybrid cultivar | D367E | 1.26643 | 0.04114 | | |
| t606894 | Cymbidium hybrid cultivar | Y142F | 1.26586 | 0.09867 | | |
| t607288 | Cymbidium hybrid cultivar | T289D | 1.26389 | 0.05999 | | |
| t606952 | Cymbidium hybrid cultivar | V71Y | 1.26229 | 0.12989 | | |
| t607197 | Cymbidium hybrid cultivar | G84C | 1.26224 | 0.07225 | | |
| t607146 | Cymbidium hybrid cultivar | G262T | 1.26188 | 0.03879 | | |
| t607017 | Cymbidium hybrid cultivar | N78E | 1.26073 | 0.09115 | | |
| t607456 | Cymbidium hybrid cultivar | T111Q | 1.25899 | 0.07745 | | |
| t606854 | Cymbidium hybrid cultivar | L144I | 1.25807 | 0.22743 | | |
| t606838 | Cymbidium hybrid cultivar | R123N | 1.25683 | 0.23657 | | |
| t607213 | Cymbidium hybrid cultivar | T289G | 1.25405 | 0.08316 | | |
| t606932 | Cymbidium hybrid cultivar | S18T | 1.25389 | 0.12779 | | |
| t607349 | Cymbidium hybrid cultivar | K282D | 1.25244 | 0.08104 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t607585 | Cymbidium hybrid cultivar | L83I | 1.2509 | 0.04892 | | |
| t606956 | Cymbidium hybrid cultivar | L83M | 1.24841 | 0.05473 | | |
| t607586 | Cymbidium hybrid cultivar | I326R | 1.24784 | 0.04812 | | |
| t607025 | Cymbidium hybrid cultivar | I99T | 1.24421 | 0.09819 | | |
| t607322 | Cymbidium hybrid cultivar | R123K | 1.24342 | 0.08106 | | |
| t606905 | Cymbidium hybrid cultivar | V388A | 1.24241 | 0.09318 | | |
| t606835 | Cymbidium hybrid cultivar | Q161F | 1.24193 | 0.10262 | | |
| t607104 | Cymbidium hybrid cultivar | E323H | 1.24084 | 0.05988 | | |
| t607135 | Cymbidium hybrid cultivar | E28P | 1.24063 | 0.06484 | | |
| t606891 | Cymbidium hybrid cultivar | K356Q | 1.24008 | 0.09459 | | |
| t607031 | Cymbidium hybrid cultivar | N80H | 1.23893 | 0.09737 | | |
| t607317 | Cymbidium hybrid cultivar | C82E | 1.23849 | 0.03065 | | |
| t607088 | Cymbidium hybrid cultivar | P303V | 1.23838 | 0.07685 | | |
| t607262 | Cymbidium hybrid cultivar | L385M | 1.23811 | 0.14991 | | |
| t606896 | Cymbidium hybrid cultivar | Q115S | 1.2378 | 0.10758 | | |
| t607269 | Cymbidium hybrid cultivar | A333R | 1.23132 | 0.05599 | | |
| t607294 | Cymbidium hybrid cultivar | K359M | 1.22923 | 0.04507 | | |
| t607344 | Cymbidium hybrid cultivar | A252E | 1.22825 | 0.1572 | | |
| t607159 | Cymbidium hybrid cultivar | L76I | 1.22743 | 0.10259 | | |
| t606890 | Cymbidium hybrid cultivar | K112R | 1.22535 | 0.04006 | | |
| t607284 | Cymbidium hybrid cultivar | F70M | 1.22458 | 0.03416 | | |
| t607292 | Cymbidium hybrid cultivar | V331I | 1.22387 | 0.05296 | | |
| t607476 | Cymbidium hybrid cultivar | L20F | 1.22172 | 0.06972 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_Corchorus OLS (per OD) | Standard Deviation Olivetol Normalized to t606797_Corchorus OLS |
|---|---|---|---|---|---|---|
| t606946 | Cymbidium hybrid cultivar | N151P | 1.22164 | 0.0856 | | |
| t607320 | Cymbidium hybrid cultivar | T111E | 1.22064 | 0.07826 | | |
| t607083 | Cymbidium hybrid cultivar | G84S | 1.21542 | 0.11127 | | |
| t607480 | Cymbidium hybrid cultivar | A13V | 1.21428 | 0.00581 | | |
| t606909 | Cymbidium hybrid cultivar | W368H | 1.21403 | 0.1423 | | |
| t607449 | Cymbidium hybrid cultivar | E203P | 1.21329 | 0.09644 | | |
| t606851 | Cymbidium hybrid cultivar | I293V | 1.21178 | 0.19419 | | |
| t607079 | Cymbidium hybrid cultivar | S34E | 1.21014 | 0.05037 | | |
| t607282 | Cymbidium hybrid cultivar | R100T | 1.20952 | 0.03641 | | |
| t606967 | Cymbidium hybrid cultivar | M135A | 1.20347 | 0.12224 | | |
| t606938 | Cymbidium hybrid cultivar | D88A | 1.19819 | 0.02307 | | |
| t607433 | Cymbidium hybrid cultivar | L291V | 1.19755 | 0.06191 | | |
| t607357 | Cymbidium hybrid cultivar | T243A | 1.19607 | 0.10095 | | |
| t607122 | Cymbidium hybrid cultivar | F374L | 1.19551 | 0.12138 | | |
| t607110 | Cymbidium hybrid cultivar | R317T | 1.19291 | 0.05771 | | |
| t607015 | Cymbidium hybrid cultivar | G84T | 1.19021 | 0.12242 | | |
| t607087 | Cymbidium hybrid cultivar | E96A | 1.18792 | 0.06196 | | |
| t607019 | Cymbidium hybrid cultivar | I99A | 1.18519 | 0.12123 | | |
| t606839 | Cymbidium hybrid cultivar | D207S | 1.17855 | 0.17153 | | |
| t606942 | Cymbidium hybrid cultivar | R100P | 1.17753 | 0.09144 | | |
| t607164 | Cymbidium hybrid cultivar | V327A | 1.17683 | 0.0485 | | |
| t606906 | Cymbidium hybrid cultivar | E28A | 1.1681 | 0.05241 | | |
| t606868 | Cymbidium hybrid cultivar | L248I | 1.16589 | 0.03553 | | |

TABLE 11B-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t607089 | Cymbidium hybrid cultivar | L77I | 1.16044 | 0.02039 | | |
| t606910 | Cymbidium hybrid cultivar | N89P | 1.15844 | 0.18953 | | |
| t606936 | Cymbidium hybrid cultivar | T111K | 1.15338 | 0.07375 | | |
| t606856 | Cymbidium hybrid cultivar | V157T | 1.14804 | 0.06609 | | |
| t607450 | Cymbidium hybrid cultivar | I99R | 1.13733 | 0.02723 | | |
| t606960 | Cymbidium hybrid cultivar | N78R | 1.13483 | 0.06431 | | |
| t607600 | Cymbidium hybrid cultivar | R123A | 1.13448 | 0.08691 | | |
| t606940 | Cymbidium hybrid cultivar | A13S | 1.13438 | 0.04862 | | |
| t607085 | Cymbidium hybrid cultivar | K55R | 1.12814 | 0.06807 | | |
| t607474 | Cymbidium hybrid cultivar | G262A | 1.12724 | 0.09746 | | |
| t606959 | Cymbidium hybrid cultivar | A219C | 1.1175 | 0.07755 | | |
| t606859 | Cymbidium hybrid cultivar | I99E | 1.10483 | 0.19373 | | |
| t606904 | Cymbidium hybrid cultivar | S10R | 1.10411 | 0.13592 | | |
| t607195 | Cymbidium hybrid cultivar | T111R | 1.10148 | 0.06594 | | |
| t607445 | Cymbidium hybrid cultivar | P305N | 1.0924 | 0.04527 | | |
| t607273 | Cymbidium hybrid cultivar | V341P | 1.09021 | 0.01522 | | |
| t606834 | Cymbidium hybrid cultivar | V157I | 1.07903 | 0.07146 | | |
| t607254 | Cymbidium hybrid cultivar | G262T | 1.07703 | 0.05546 | | |
| t606828 | Cymbidium hybrid cultivar | A107M | 1.07407 | 0.12564 | | |
| t606836 | Cymbidium hybrid cultivar | K104Q | 1.07292 | 0.1499 | | |
| t607081 | Cymbidium hybrid cultivar | I99G | 1.0581 | 0.0688 | | |
| t607482 | Cymbidium hybrid cultivar | R24K | 1.05409 | 0.07847 | | |
| t607132 | Cymbidium hybrid cultivar | D208A | 1.01083 | 0.07712 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| t606874 | Cymbidium hybrid cultivar | D208S | 0.95301 | 0.04077 | | |
| t607190 | Cymbidium hybrid cultivar | L137M | 0.90492 | 0.02932 | | |
| t607028 | Cymbidium hybrid cultivar | D208N | 0.88114 | 0.04406 | | |
| t607370 | Cymbidium hybrid cultivar | L264F | 0.87471 | 0.07388 | | |
| t606898 | Cymbidium hybrid cultivar | I102A | 0.85753 | 0.12759 | | |
| t607216 | Cymbidium hybrid cultivar | Q206L | 0.83138 | 0.05303 | | |
| t606901 | Cymbidium hybrid cultivar | D208C | 0.82507 | 0.10608 | | |
| t607256 | Cymbidium hybrid cultivar | G373A | 0.65595 | 0.02379 | | |
| t607131 | Cymbidium hybrid cultivar | N51D | 0.5808 | 0.70692 | | |
| t607604 | Cymbidium hybrid cultivar | I99K | 0.57364 | 0.66547 | | |
| t606914 | Cymbidium hybrid cultivar | A13N | 0.56823 | 0.65663 | | |
| t606934 | Cymbidium hybrid cultivar | S10N | 0.54561 | 0.63028 | | |
| t607312 | Cymbidium hybrid cultivar | I255M | 0.16984 | 0.01174 | | |
| t607377 | Cymbidium hybrid cultivar | S339W | 0 | 0 | | |
| t607318 | Cymbidium hybrid cultivar | E28P F40Y N51D K54E N80H C82E L83I G84C F86Y D88A N89P N92D F97M I99R T111E R123K L137M I147L N151P C176D S180N K182P Q206L H233N S237F A252E S260G G262A G281E T289K D367E | 0.78529 | 0.05769 | | |
| t607245 | Cymbidium hybrid cultivar | E28P G84C N89P T111R N151P C176D | 0.77803 | 0.02842 | | |

TABLE 11B-continued

Results of Secondary Screen of Protein Engineering Library Using C. sativa, Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| | | Q206L S237F A252E G262T G281E | | | | |
| t607000 | Cymbidium hybrid cultivar | G373A F374L | 0.71402 | 0.06528 | | |
| t607337 | Cymbidium hybrid cultivar | E28P N51E N80H C82E L83I G84C F86Y D88A N89P N92D F97M I99R T111R R123K L137M I147L N151P C176D S180N K182P Q206L H233N S237F A252E S260G G262A G281E T289K D367E | 0.66352 | 0.03712 | | |
| t607265 | Cymbidium hybrid cultivar | E28P F40Y N51D K54E N80H C82E L83I G84C F86Y D88A N89P N92D F97M I99R T111Q R123K L137M I147L N151P C176D S180N K182P Q206L H233N S237F A252E S260G G262A G281E T289K D367E | 0.64379 | 0.0247 | | |
| t607316 | Cymbidium hybrid cultivar | W301Y P303V P305N R308P A309T | 0.49342 | 0.01579 | | |
| t607435 | Cymbidium hybrid cultivar | E28P N51D K54E N80H C82E L83I G84C F86Y D88A N89P N92D F97M I99R T111E R123K L137M I147L | 0.46307 | 0.30921 | | |

TABLE 11B-continued

Results of Secondary Screen of Protein Engineering Library Using C. sativa,
Cochorus, and Cymbidium Templates (not supplemented with sodium hexanoate)

| Strain | Wild-type template used | Amino Acid mutations from wild-type | Average Normalized Olivetol (per OD) | Standard Deviation Normalized Olivetol | Average Olivetol Normalized to t606797_ Corchorus OLS (per OD) | Standard Deviation Olivetol Normalized to t606797_ Corchorus OLS |
|---|---|---|---|---|---|---|
| | | N151P C176D S180N K182P Q206L H233N S237F A252E S260G G262A G281E T289K D367E | | | | |
| t607381 | Cymbidium hybrid cultivar | A266Y P305N S339W | 0.01389 | 0.02777 | | |
| t607124 | Cymbidium hybrid cultivar | I255M A266Y W301Y P303V P305N R308P A309T S339W V341P G373A F374L | 0.01165 | 0.02329 | | |
| t607280 | Cymbidium hybrid cultivar | A266Y P305N S339W V341P G373A F374L | 0 | 0 | | |
| t607290 | Cymbidium hybrid cultivar | A266Y S339W | 0 | 0 | | |

TABLE 12

Screening Results in Prototrophic S. cerevisiae strain

| Strain | Strain type | Average Olivetol [µg/L] | Standard Deviation Olivetol [µg/L] |
|---|---|---|---|
| t473139 | Negative Control | 0 | 0 |
| t496101 | Cannabis OLS variant (positive control) | 20254.13 | 2236.483 |
| t496102 | Library | 20566.05 | 2055.026 |
| t485668 | Library | 24062.45 | 4250.129 |
| t496079 | Library | 29485.08 | 2786.913 |
| t485662 | Library | 50257.28 | 3891.439 |
| t496084 | t496084 Cannabis OLS T335C point mutant | 53595.65 | 7035.556 |
| t485672 | Library | 53606.37 | 6230.06 |
| t496073 | Library | 56729.84 | 4435.122 |

TABLE 13

Sequence Information for Strains described in Table 9

| Strain | Nucleotide Sequence (SEQ ID NO) | Protein Sequence (SEQ ID NO) |
|---|---|---|
| t405417 | 250 | 207 |
| t404953 | 251 | 208 |
| t405220 | 252 | 209 |
| t404192 | 253 | 210 |
| t404323 | 254 | 211 |
| t404196 | 255 | 212 |
| t404209 | 256 | 213 |
| t404164 | 257 | 214 |
| t404170 | 258 | 215 |
| t404384 | 259 | 216 |
| t405397 | 260 | 217 |
| t405164 | 261 | 218 |
| t404191 | 262 | 219 |
| t405340 | 263 | 220 |
| t404421 | 264 | 221 |
| t404631 | 265 | 222 |
| t405133 | 266 | 223 |
| t405081 | 267 | 224 |
| t404898 | 268 | 225 |
| t405017 | 269 | 226 |
| t405140 | 270 | 227 |
| t404276 | 271 | 228 |

TABLE 13-continued

Sequence Information for Strains described in Table 9

| Strain | Nucleotide Sequence (SEQ ID NO) | Protein Sequence (SEQ ID NO) |
|---|---|---|
| t404405 | 272 | 229 |
| t405079 | 273 | 230 |
| t404978 | 274 | 231 |
| t405347 | 275 | 232 |
| t404855 | 276 | 233 |
| t405362 | 277 | 234 |
| t404523 | 278 | 235 |
| t404951 | 279 | 236 |
| t405308 | 280 | 237 |
| t405201 | 281 | 238 |
| t404219 | 282 | 239 |
| t404673 | 283 | 240 |
| t404274 | 284 | 241 |
| t405042 | 285 | 242 |
| t404528 | 286 | 243 |
| t405312 | 287 | 244 |
| t404725 | 288 | 245 |
| t405303 | 289 | 246 |
| t405395 | 290 | 247 |
| t405326 | 291 | 248 |
| t404599 | 292 | 249 |

TABLE 14

Sequence Information for Strains Described in Tables 10A-10B

| Strain | Nucleotide Sequence (SEQ ID NO) | Protein Sequence (SEQ ID NO) |
|---|---|---|
| t606794 | 96 | 80 |
| t527340 | 62 | 5 |
| t607067 | 421 | 293 |
| t607367 | 422 | 294 |
| t607391 | 423 | 295 |
| t606801 | 424 | 296 |
| t606984 | 425 | 297 |
| t606899 | 426 | 298 |
| t606797 | 37 | 6 |
| t606807 | 427 | 299 |
| t607179 | 428 | 300 |
| t607149 | 429 | 301 |
| t607139 | 430 | 302 |
| t607112 | 431 | 303 |
| t607332 | 432 | 304 |
| t607153 | 433 | 305 |
| t607158 | 434 | 306 |
| t607236 | 435 | 307 |
| t607141 | 436 | 308 |
| t607176 | 437 | 309 |
| t606930 | 438 | 310 |
| t607193 | 439 | 311 |
| t607006 | 440 | 312 |
| t606993 | 441 | 313 |
| t606852 | 442 | 314 |
| t607119 | 443 | 315 |
| t607371 | 444 | 316 |
| t527346 | 38 | 7 |
| t606952 | 445 | 317 |
| t607284 | 446 | 318 |
| t607262 | 447 | 319 |
| t606938 | 448 | 320 |
| t607260 | 449 | 321 |
| t607159 | 450 | 322 |
| t606946 | 451 | 323 |
| t606861 | 452 | 324 |
| t606918 | 453 | 325 |
| t607135 | 454 | 326 |
| t607286 | 455 | 327 |
| t606942 | 456 | 328 |
| t606959 | 457 | 329 |
| t607294 | 458 | 330 |
| t607282 | 459 | 331 |
| t607230 | 460 | 332 |
| t606965 | 461 | 333 |
| t607288 | 462 | 334 |
| t607228 | 463 | 335 |
| t606909 | 464 | 336 |
| t606962 | 465 | 337 |
| t607150 | 466 | 338 |
| t607361 | 467 | 339 |
| t606932 | 468 | 340 |
| t606940 | 469 | 341 |
| t607269 | 470 | 342 |
| t607186 | 471 | 343 |
| t607476 | 472 | 344 |
| t607031 | 473 | 345 |
| t606916 | 474 | 346 |
| t607292 | 475 | 347 |
| t606908 | 476 | 348 |
| t607248 | 477 | 349 |
| t607023 | 478 | 350 |
| t606936 | 479 | 351 |
| t607433 | 480 | 352 |
| t607600 | 481 | 353 |
| t606894 | 482 | 354 |
| t606963 | 483 | 355 |
| t607603 | 484 | 356 |
| t607452 | 485 | 357 |
| t607197 | 486 | 358 |
| t606996 | 487 | 359 |
| t607043 | 488 | 360 |
| t607254 | 489 | 361 |
| t607478 | 490 | 362 |
| t607132 | 491 | 363 |
| t607109 | 492 | 364 |
| t607155 | 493 | 365 |
| t606956 | 494 | 366 |
| t606906 | 495 | 367 |
| t607195 | 496 | 368 |
| t607449 | 497 | 369 |
| t607256 | 498 | 370 |
| t607349 | 499 | 371 |
| t606960 | 500 | 372 |
| t607601 | 501 | 373 |
| t607021 | 502 | 374 |
| t606874 | 503 | 375 |
| t607320 | 504 | 376 |
| t607317 | 505 | 377 |
| t607224 | 506 | 378 |
| t606912 | 507 | 379 |
| t607602 | 508 | 380 |
| t606905 | 509 | 381 |
| t607156 | 510 | 382 |
| t607474 | 511 | 383 |
| t607482 | 512 | 384 |
| t606854 | 513 | 385 |
| t607032 | 514 | 386 |
| t606830 | 515 | 387 |
| t606961 | 516 | 388 |
| t606868 | 517 | 389 |
| t607083 | 518 | 390 |
| t606958 | 519 | 391 |
| t607273 | 520 | 392 |
| t607241 | 521 | 393 |
| t606857 | 522 | 394 |
| t606901 | 523 | 395 |
| t607015 | 524 | 396 |
| t607586 | 525 | 397 |
| t607122 | 526 | 398 |
| t606882 | 527 | 399 |
| t607146 | 528 | 400 |
| t607585 | 529 | 401 |
| t606828 | 530 | 402 |
| t607081 | 531 | 403 |

TABLE 14-continued

Sequence Information for Strains Described in Tables 10A-10B

| Strain | Nucleotide Sequence (SEQ ID NO) | Protein Sequence (SEQ ID NO) |
|---|---|---|
| t606887 | 532 | 404 |
| t606891 | 533 | 405 |
| t607160 | 534 | 406 |
| t607194 | 535 | 407 |
| t607377 | 537 | 409 |
| t607265 | 538 | 410 |
| t607000 | 539 | 411 |
| t607245 | 540 | 412 |
| t607318 | 541 | 413 |
| t607435 | 542 | 414 |
| t607337 | 543 | 415 |
| t607316 | 544 | 416 |
| t607124 | 545 | 417 |
| t607280 | 546 | 418 |
| t607290 | 547 | 419 |
| t607381 | 548 | 420 |

TABLE 15

Sequence Information for Strains Described in Tables 11A-11B

| Strain | Nucleotide Sequence (SEQ ID NO) | Protein Sequence (SEQ ID NO) |
|---|---|---|
| t527340 | 62 | 5 |
| t606801 | 424 | 296 |
| t607067 | 421 | 293 |
| t607367 | 422 | 294 |
| t606794 | 96 | 80 |
| t607391 | 423 | 295 |
| t606984 | 425 | 297 |
| t606899 | 426 | 298 |
| t606797 | 37 | 6 |
| t606807 | 427 | 299 |
| t606930 | 438 | 310 |
| t607179 | 428 | 300 |
| t607332 | 432 | 304 |
| t607236 | 435 | 307 |
| t607006 | 440 | 312 |
| t606993 | 441 | 313 |
| t607139 | 430 | 302 |
| t607158 | 434 | 306 |
| t607153 | 433 | 305 |
| t606852 | 442 | 314 |
| t607112 | 431 | 303 |
| t607119 | 443 | 315 |
| t607141 | 436 | 308 |
| t607149 | 429 | 301 |
| t607176 | 437 | 309 |
| t607193 | 439 | 311 |
| t607371 | 444 | 316 |
| t527346 | 38 | 7 |
| t607221 | 628 | 549 |
| t607228 | 463 | 335 |
| t606878 | 629 | 550 |
| t606986 | 630 | 551 |
| t606999 | 631 | 552 |
| t607224 | 506 | 378 |
| t606976 | 632 | 553 |
| t607241 | 521 | 393 |
| t607603 | 484 | 356 |
| t607222 | 633 | 554 |
| t607014 | 634 | 555 |
| t606994 | 635 | 556 |
| t606982 | 636 | 557 |
| t606995 | 637 | 558 |
| t607007 | 638 | 559 |
| t607008 | 639 | 560 |
| t606965 | 461 | 333 |
| t607107 | 640 | 561 |

TABLE 15-continued

Sequence Information for Strains Described in Tables 11A-11B

| Strain | Nucleotide Sequence (SEQ ID NO) | Protein Sequence (SEQ ID NO) |
|---|---|---|
| t607194 | 535 | 407 |
| t606981 | 641 | 562 |
| t606979 | 642 | 563 |
| t606975 | 643 | 564 |
| t607230 | 460 | 332 |
| t607004 | 644 | 565 |
| t606996 | 487 | 359 |
| t607046 | 645 | 566 |
| t607043 | 488 | 360 |
| t607021 | 502 | 374 |
| t607109 | 492 | 364 |
| t607036 | 646 | 567 |
| t606912 | 507 | 379 |
| t607602 | 508 | 380 |
| t607361 | 467 | 339 |
| t606882 | 527 | 399 |
| t606962 | 465 | 337 |
| t607150 | 466 | 338 |
| t607252 | 647 | 568 |
| t607225 | 648 | 569 |
| t607032 | 514 | 386 |
| t607248 | 477 | 349 |
| t607155 | 493 | 365 |
| t606958 | 519 | 391 |
| t607023 | 478 | 350 |
| t607027 | 649 | 570 |
| t606892 | 650 | 571 |
| t607035 | 651 | 572 |
| t607237 | 652 | 573 |
| t607189 | 653 | 574 |
| t607118 | 654 | 575 |
| t607018 | 655 | 576 |
| t607045 | 656 | 577 |
| t606888 | 657 | 578 |
| t607220 | 658 | 579 |
| t606830 | 515 | 387 |
| t606832 | 659 | 580 |
| t607601 | 501 | 373 |
| t606857 | 522 | 394 |
| t607452 | 485 | 357 |
| t607218 | 660 | 581 |
| t607186 | 471 | 343 |
| t607123 | 661 | 582 |
| t607286 | 455 | 327 |
| t606918 | 453 | 325 |
| t606916 | 474 | 346 |
| t606990 | 662 | 583 |
| t606908 | 476 | 348 |
| t606963 | 483 | 355 |
| t607226 | 663 | 584 |
| t606961 | 516 | 388 |
| t607260 | 449 | 321 |
| t607160 | 534 | 406 |
| t607156 | 510 | 382 |
| t607478 | 490 | 362 |
| t606887 | 532 | 404 |
| t606861 | 452 | 324 |
| t607217 | 664 | 585 |
| t606894 | 482 | 354 |
| t607288 | 462 | 334 |
| t606952 | 445 | 317 |
| t607197 | 486 | 358 |
| t607146 | 528 | 400 |
| t607017 | 665 | 586 |
| t607456 | 666 | 587 |
| t606854 | 513 | 385 |
| t606838 | 667 | 588 |
| t607213 | 668 | 589 |
| t606932 | 468 | 340 |
| t607349 | 499 | 371 |
| t607585 | 529 | 401 |
| t606956 | 494 | 366 |
| t607586 | 525 | 397 |
| t607025 | 669 | 590 |

TABLE 15-continued

Sequence Information for Strains Described in Tables 11A-11B

| Strain | Nucleotide Sequence (SEQ ID NO) | Protein Sequence (SEQ ID NO) |
|---|---|---|
| t607322 | 670 | 591 |
| t606905 | 509 | 381 |
| t606835 | 671 | 592 |
| t607104 | 672 | 593 |
| t607135 | 454 | 326 |
| t606891 | 533 | 405 |
| t607031 | 473 | 345 |
| t607317 | 505 | 377 |
| t607088 | 673 | 594 |
| t607262 | 447 | 319 |
| t606896 | 674 | 595 |
| t607269 | 470 | 342 |
| t607294 | 458 | 330 |
| t607344 | 675 | 596 |
| t607159 | 450 | 322 |
| t606890 | 676 | 597 |
| t607284 | 446 | 318 |
| t607292 | 475 | 347 |
| t607476 | 472 | 344 |
| t606946 | 451 | 323 |
| t607320 | 504 | 376 |
| t607083 | 518 | 390 |
| t607480 | 677 | 598 |
| t606909 | 464 | 336 |
| t607449 | 497 | 369 |
| t606851 | 678 | 599 |
| t607079 | 679 | 600 |
| t607282 | 459 | 331 |
| t606967 | 680 | 601 |
| t606938 | 448 | 320 |
| t607433 | 480 | 352 |
| t607357 | 681 | 602 |
| t607122 | 526 | 398 |
| t607110 | 682 | 603 |
| t607015 | 524 | 396 |
| t607087 | 683 | 604 |
| t607019 | 684 | 605 |
| t606839 | 685 | 606 |
| t606942 | 456 | 328 |
| t607164 | 686 | 607 |
| t606906 | 495 | 367 |
| t606868 | 517 | 389 |
| t607089 | 687 | 608 |
| t606910 | 688 | 609 |
| t606936 | 479 | 351 |
| t606856 | 689 | 610 |
| t607450 | 690 | 611 |
| t606960 | 500 | 372 |
| t607600 | 481 | 353 |
| t606940 | 469 | 341 |
| t607085 | 691 | 612 |
| t607474 | 511 | 383 |
| t606959 | 457 | 329 |
| t606859 | 692 | 613 |
| t606904 | 693 | 614 |
| t607195 | 496 | 368 |
| t607445 | 694 | 615 |
| t607273 | 520 | 392 |
| t606834 | 695 | 616 |
| t607254 | 489 | 361 |
| t606828 | 530 | 402 |
| t606836 | 696 | 617 |
| t607081 | 531 | 403 |
| t607482 | 512 | 384 |
| t607132 | 491 | 363 |
| t606874 | 503 | 375 |
| t607190 | 697 | 618 |
| t607028 | 698 | 619 |
| t607370 | 699 | 620 |
| t606898 | 700 | 621 |
| t607216 | 701 | 622 |
| t606901 | 523 | 395 |
| t607256 | 498 | 370 |
| t607131 | 702 | 623 |
| t607604 | 703 | 624 |
| t606914 | 704 | 625 |
| t606934 | 705 | 626 |
| t607312 | 536 | 408 |
| t607377 | 537 | 409 |
| t607318 | 541 | 413 |
| t607245 | 540 | 412 |
| t607000 | 539 | 411 |
| t607337 | 543 | 415 |
| t607265 | 538 | 410 |
| t607316 | 544 | 416 |
| t607435 | 542 | 414 |
| t607381 | 548 | 420 |
| t607124 | 545 | 417 |
| t607280 | 546 | 418 |
| t607290 | 547 | 419 |

TABLE 16

Sequence Information for Strains Described in Table 12

| Strain | Nucleotide Sequence (SEQ ID NO) | Amino Acid Sequence (SEQ ID NO) |
|---|---|---|
| t496101 | 62 | 5 |
| t496102 | 39 | 8 |
| t485668 | 44 | 13 |
| t496079 | 47 | 16 |
| t485662 | 46 | 15 |
| t496084 | 706 | 627 |
| t485672 | 48 | 17 |
| t496073 | 38 | 7 |

EQUIVALENTS

Those skilled in the art will recognize, or be able to ascertain using no more than routine experimentation, many equivalents to the specific embodiments of the invention described herein. Such equivalents are intended to be encompassed by the following claims.

All references, including patent documents, disclosed herein are incorporated by reference in their entirety.

SEQUENCE LISTING (715 sequences)

SEQ ID NO: 1 - protein, 393 aa, Aquilegia coerulea
MVDINTIRRTQRACGAATVMAIGTANPPNSVDQINYPDYYFRITKSDHMTELKEKFKRMCAKSMIKTRYLHLTEDLLKKNPNLGAYKAPSLNARQDILVEEIPKLGKEAAVKAIQEWGQPKSEITHLIFCSTGGVDTPGADFQLTKLLGLQLSVKRYMMYQQGCFSGGMVLRLAKDLAENNRGARVLVVCSEITVLTFHGPSSTNLDSLLGQAIFGDGAAAVIVGADPVIGIEKPLFKIVSASQTIIPDCGDAIDGHLREEGLIFHLQKTVPELVSMNIKKSLEEAFEPLGISDWNSLFWIVHPGGPKILNQVELKLNLEPEKLALSRHVLSEYGNMSGACVLFVLDKMRTKSVQEGLQTTGEGLEWGVLFGFGPGLTVETLVLHSVLIHDNS

SEQ ID NO: 2 - protein, 392 aa, Vitis pseudoreticulata
MAFMEEIRNAQRAKGPATVLAIGTATPDNCLYQSDFADYYFRVTKSEHMTELKKKFNRICDKSMIKKRYIHLTEEMLEEHPNIGAYMAPSLNIRQEIITAEVPKLGKEAALKALKEWGQPKSKITHLVFCTTSGVEMPGADYKLANLLGLEPSVRRVMLYHQGCYAGGTVLRTAKDLAENNAGARVLVVCSEITVVTFRGPSEDALDSLVGQALFGDGSAAVIVGSDPDISIERPLFQLVSAAQTFIPNSAGAIAGNLREVGLTFHLWPNVPTLISENIENCLTKAFDPIGISDWNSLFWIAHPGGPAILDAVEAKVGLDKQKLKATRHILSEYGNMSSACVLFILDEMRKKSLKEGKTTTGEGLDWGVLFGFGPGLTIETVVLHSVGTDSN

SEQ ID NO: 3 - protein, 394 aa, Unknown
  Brassica rapa subsp. Pekinensis
MVMGALSLDEIRKAQRGDGPASILAIGTANPPNQVIQAEYPDYYFRITNSEHMTDLKEKFKRMCDKSMIKKRYMHLTEEFLKDNPNVCAFMAPSLDVRQDILVAEVPKLGKEAAVKAITEWGQPKSKITHLVFCTTSGVDMPGADYQLIKLLGLCPSVKRVMMYHQGCYAGGTVLRVAKDIAENNRGARVLIVCSEITVVTFRGPSETHLDSLVGQSLFGDGAAALIVGSDPDTSVGEKPIFEMVSAAQTILPDSQGAIEGHLKEVGLTFHLLKTVPGLISKNIEKCLEEAFKPLGISDWNSLFWIAHPGGPAILDQVEIKLGLKPEKMKATRHVLSEYGNMSSACVFFILDEMRRKAVEDGAETTGEGLEWGVLFGFGPGLTVETVVLHSVPL

SEQ ID NO: 4 - protein, 398 aa, Sorghum bicolor
MTTGKVTLEAVRKAQRAEGPATVLAIGTATPANCVYQADYPDYYFRVTKSEHLTDLKEKFKRICHKSMIRKRYMHLTEDILEENPNMSSYWAPSLDARQDILIQEIPKLGAEAAEKALKEWGQPRSRITHLVFCTTSGVDMPGADYQLIKLLGLCPSVNRAMMYHQGCFAGGMVLRLAKDLAENNRGARVLIVCSEITVVTFRGPSESHLDSLVGQALFGDGAAAVIVGADPSEPAERPLFHLVSASQTILPDSEGAIEGHLREVGLTFHLQDRVPQLISMNIERLLEDAFAPLGISDWNSIFWVAHPGGPAILNMVEAKVGLDKARMCATRHILAEYGNMSSVCVLFILDEMRNRSAKDGHTTTGEGMEWGVLFGFGPGLTVETIVLHSVPITTVAA

SEQ ID NO: 5 - protein, 385 aa, Cannabis sativa
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 6 - protein, 396 aa, Corchorus olitorius
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 7 - protein, 390 aa, Cymbidium hybrid cultivar
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 8 - protein, 394 aa, Paphiopedilum helenae
MPGLENRKKVEAPKRAEGLATILAIGRANPPNAMEQSTFPDFYFRVTNSEHLVGLEKKFERICEKTAIRRRHFVWNGEILNANPCLRTHMEPSLNVRQKIAVAEIPKLGAEAASRAIEEWGQPKSHITHLIFCTTSGMDLPGADYKLTRILGLNPNVQRVMLYQQGCFAGGTVLRLAKCFAESQKGARVLVVCSETTTVLVRAPSEDYQDDLVTQALFADGASALIVGADPDEEAKERRIFTIVSATQVILPDSDGAIGGHLGEGGLTATLHRDVPLIISKNVSKCLEEAFAPLGISDWNSIFWAPHPGGRAILDQVEERVGLKPEKLWASRHVLAEYGNMSSVCVHFVLDEIRKRSTKEGKTTTGEGFDWGVLFGFGPGLTVETVILRSVPLN

SEQ ID NO: 9 - protein, 394 aa, Brassica napus
MVMGALSLDEIRKAQRADGPASILAIGTANPPNQVIQAEYPDYYFRITNSEHMTDLKEKFKRMCDKSMIRKRYMHLTEEFLKDNPNICAFMAPSLDVRQDILVAEVPKLGKEAAVKAITEWGQPKSKITHLVFCTTSGVDMPGADYQLIKLLGLCPSVKRVMMYHQGCYAGGTVLRLAKDIAENNRGARVLIVCSEITVVTFRGPSETHLDSLVGQSLFGDGAAALIVGSDTDTSVGEKPIFEMVSAAQTILPDSQGAIEGHLKEVGLTFHLLKTVPGLISKNIEKCLEEAFKPLGISDWNSLFWIAHPGGPAILDHVEIKLGLKPEKMKATRHVLSEYGNMSSACVFFILDEMRRKAVEDGAETTGEGLEWGVLFGFGPGLTVETVVLHSVPL

SEQ ID NO: 10 - protein, 396 aa, Picea jezoensis
MSAEMTVDLETFRKTQRADGPASILAIGTANPPNAVHQSTYPDYYFRITSGEQNTDLKDKFKRICEKTAIKKRYMYLTEEILKKNPNMCAFMEVPSLDVRQAMLLVEVPRLGKEAADKALQEWGQPKSKITHLIFCSTTTADIPGADCEVAKLLGLHPSVKRVGVFQHGCFAGGTVLRLAKDVAENNRGARVLVVCSEITAVTFRGPSDTHLDSLVGQALFGDGAAALIVGADPIPQVEKPSFQIAWTAQTILPDSDDAISGKVREVGLTFHLKGAVPDLISTNIENSLVEAFRQFKISDWNQLFWIAHPGGRAILDRVEAKLNLDPGKLRATRHVLSEYGNMSSACVHFILDEMRKTSRENGYSTTGEGLEMGVLFGFGPGLTVETVVLKSVLLP

SEQ ID NO: 11 - protein, 396 aa, Pinus strobus
MSVGMGVDLEAFRKSQRADGFASILAIGTANPPNVVDQSTYPDYYFRNTNNEDNTDLKDKFKRICERSAIKKRHMYLTEEILKKNPELCAFLEVPSLDTRQAMLAVEVPRLGKEAAEKAIEEWGQPKSRITHLIFCTTTTPDLPGADFEVAKLLGLHPSVKRVGVFQHGCFAGGTVLRLAKDLAENNRGARVLVVCSENTAVTFRGPSETHLDGLVGLALFGDGAAALIVGADPIPQVEKPCFEIVWTAQTVVPNSDGAISGKLREVGLTFQLKGAVPDLISTNIEKCLVEAFSQFNISDWNQLFWIAHPGGRAILDQVEASLNLDPTKLRATRHVMSEYGNMSSACVHFILDETRKASRQNGCSTSGGGFQMGVLFGFGPGLTVETVVLKSIPFP

SEQ ID NO: 12 - protein, 389 aa, Arachis hypogaea
MVSVSEIRNIQRAEGPATVLAIGTANPSNCVDQSTYADYYFRVTDSEHMTDLKKKFQRICERTQIKNRHMYLTEEILKENPNMCAYKAPSLDAREDMMIREVPRVGKEAATKAIKEWGQPMSKITHLIFCTTSGVALPGVDYELIVLLGLDPCVKRYMMYHQGCFAGGTVLRLAKDLAENSKDARVLIVCSENTAVTFRGPSETDMDSLVGQALFADGAAAIIIGSDPVPEVEKPIFEIVSTDQKLVPGSHGAIGGLLREVGLTFYLNKSVPDIISQNINDALSKAFDPLGISDYNSIFWIAHPGGRAILDQVEQKVNLKPEKMKATRDVLSNYGNMSSACVFFIMDLMRKKSLEEGLKTTGEGLDWGVLFGFGPGLTIETVVLRSVAI

SEQ ID NO: 13 - protein, 431 aa, Nicotiana tabacum
MASLCHIPFQKQMSNCRTVHPIFGQKSRLLIKNLAKSFVPAKTATVEEIRRAQRAEGPATVLAIGTATPSNCFYQCTYPDYFFRVTNSEHKTKLKEKFKRMCDGSMIKKRYLHLTEEILKKNPNICEYKASSFDARQEIAIVEVPKLGQEAAEKAIKEWGQSKSKITHLVFCTTTSVEIPGADYQLTKLLGLDPSVKRLMMYQQGCFGGGSSLRLAKDLAENNKGARVLVVCSEITVLSFHAPSDTELDVLVGQALFSDGASAVIVGSDPILTVERPLFEIVFATQTLLPDSGHAIYGNLCESGLVAHMHKDVPILVSKDIEKIIEEVFRPLGISDWNSIFWVAHAGGRAILDQIEVKLGLKPEKLRAARHVMSEYGNMGSACVLFVLDEMRKASIKEGLGTTGEGLEWGALCGFGPGLTIETIVLHSISI

SEQ ID NO: 14 - protein, 398 aa, Setaria italica
MAAKVTVEEVRKAQRAEGPASVLAIGTVTPPNCVYQADYADYYFRVTKSEHMTELKEKFKRICRKSMIQKRYMHLTEDILLENPNMASYSAPSLNARQAILVEEVPKLGAAAAEKALKEWGQPRSQITHIIFCTTSGVDMPGADSRIIKLLGLDPSVKRVMLYHQGCFAGGMVLRIAKDLAENNRGARVLIVCSEITVVTFRGPSEAHLDSLVGQALFGDGAAAVIVGADPDEHVERPLFQMVSASETILPNSDGAIEGHLREVGLTFHLQERVPELISSNIERLLEESFKPLGISDWNSIFWVAHPGGPAILNAVESKAGIDKARLRATRQVLSEYGNMSSACVLFILDEMRKFSAEDGRATTGEGMDWGVLFGFGPGLTVETVVLHSVPITTGHAA

SEQ ID NO: 15 - protein, 390 aa, Unknown
  Phalaenopsis x Doritaenopsis hybrid cultivar
MPSLESIKKAPRADGFASILAIGRANPDNIIEQSAYPDFYFRVTNSEHLVDLKKKFQRICEKTAIRKRHFVWNEEFLTANPCFSTFMDKSLNVRQEVAISEIPKLGAKAATKAIEDWGQPKSRITHLIFCTTSGMDLPGADYQLTQILGLNPNVERVMLYQQGCFAGGTTLRLAKCLAESRKGARVLVVCAETTTVLFRAPSEEHQDDLVTQALFADGASAVIVGADPDEAADERASFVIVSTSQVLLPDSAGAIGGHVSEGGLLATLHRDVPQIVSKNVGKCLEEAFTPFGISDWNSIFWVPHPGGRAILDQVEERVGLKPEKLSVSRHVLAEYGNMSSVCVHFALDEMRKRSANEGKATTGEGLEWGVLFGFGPGLTVETVVLRSVPL

SEQ ID NO: 16 - protein, 389 aa, Arachis hypogaea
MVSVSGIRNVERAEGPATVLAIGTANPSNCVDQSTYADYYFRVTNSEHMTDLKKKFQRICERTQIKNRHMYLTEEILKENPNICAYKAPSLDAREDMMIREVPRVGKEAATKAIKEWGQPMSKITHLIFCTTSGVALPGVDYELIVLLGLDPCVKRYMMYHQGCFAGGTVLRLAKDLAENNKDARVLIVCSENTAVTFRGPSETDMDSLVGQALFADGAAAIIIGSDPVPEVEKPLFEIVSTDQKLVPGSHGAIGGLLREVGLTFYLNKSVPDIISQNINDALSKAFDPLGISDYNSIFWIAHPGGRAILDQVEQKVNLKPEKMKATRDVLSNYGNMSSACVFFIMDLMRKKSLEEGLKTTGEGLDWGVLFGFGPGLTIETVVLRSVAI

SEQ ID NO: 17 - protein, 392 aa, Araucaria cunninghamii
MSMENVEAFGKAQRADGQASILAIGTANPPNIVYQSTFPDYYFGITNNEHKIDLKEKFRRICEKSMVTKRHMHLTEEILKENPNMCAYRAPSMDSRHDIIREEVPRLGKEAAVRAINEWGRSKSEITHLVFCTTSGVDMPGADYQLMRLLGLRPSVKRVMLSHQGCFAGGTVLRLAKDLAENNRGARVLVVCSETTAVTFRGPDHTRFDNLVGQALFADGAAALVVGADAVQGLETPCFHLLWNAQTILPESEGAIEGHLREVGLTFQLLHSVPQLISDNIEAALKEAFRHSGVSDWNDLFWIAHPGGPAILDAVESKLQLDPKKLRATRHVLSEYGNMSSASVLFVLDEMRKGSRRGGCANTGEGLDLGVLFGFGPGLTVETVVLRSVRLQ

SEQ ID NO: 18 - protein, 393 aa, Phaseolus vulgaris
MAHLEEIREKQRARGPATILAIGTATPSNCIYQSDFTDYYFRVTKSDHMTQLKAKLKRICEKSMIEKRYIHLTEEMLKENPNIGAYEEPSLDVRQDILVEEVPKLGEKAASKALKEWGRPRSDITHLIFCSTSGVDMPGADYQLLRLLGLKPSTKRFMLYHQGCYAGGTVLRLAKDLAENNVGARILVVCSEITVVTFRGPCETHLDSLVGQALFGDGASSVIVGSDPDTSIERPLFHLVSASETILPNSEGAIEGHLREVGLTFHLKDNVPQLIGENIEKSLEEAFHPLGISDWNSLFWVAHPGGPAILKQIEATLGLNPDKLRATKQVLKEYGNMSSACVLFILDEMRSWSLEKGKSSTGEGLKWGVLYGFGPGLTMETIVLHSAAVDPNN

SEQ ID NO: 19 - protein, 392 aa, Vitis quinquangularis
MASVEEFRNAQRAKGPATILAIGTATPDHCVYQSDYADYYFRVTKSEHMTELKKKFNRICDKSMIKKRYIHLTEEMLEEHPNIGAYMAPSLNIRQEIITAEVPKLGKEAALKALKEWGQPKSKITHLVFCTTSGVEMPGADYKLANLLGLETSVRRVMLYHQGCYAGGTVLRTAKDLAENNAGARVLVVCSEITVVTFRGPSEDALDSLVGQALFGDGSAAVIVGSDPDVSIERPLFQLVSAAQTFIPNSAGAIAGNLREVGLTFHLWPNVPTLISENIEKCLSQAFDPLGISDWNSLFWIAHPGGPAILDAVEAKLNLEKKKLEATRHVLSEYGNMSSACVLFILDEMRKKSLKGENATTGEGLDWGVLFGFGPGLTIETVVLHSIPTVTN

SEQ ID NO: 20 - protein, 395 aa, Cardamine penzesii
MVMGDMPSLDEIRKAQRADGPAGILAIGTANPANYVIQAEYPDYYFRITNSEHMTDLKEKFKRMCDKSTIRKRHMHVTEEFLKENPNMCAYMAPSLDARQDIVVVEVPKLGKEAAVKAIKEWGQPKSKITHLVFCTTSGVDMPGADYQLTKLLGLRPSVKRLMMYQQGCFAGGTVLRLAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIEKSLDEAFKPLGISDWNSIFWIAHPGGPAILDQVEIKLGLKEEKMRATRHVMREYGNMSSACVLFILDEMRKKSAKDGVATTGEGLEWGVLFGFGPGLTVETVVLHSVPL

SEQ ID NO: 21 - protein, 389 aa, Medicago truncatula
MMKVSEIRKAQRAEGPATILAIGTANPPNCVEQSTYPDFYFRVTNSEHKIKLKEKFQRICDKTMIKRRYMYLTEEILKENPNLCTYMAPSLDTRQDMVVVEAPRLGKEAAVKAIKEWGQPKSKITHLIFCTISGVDMPGADYQLTKLLGLRPCVKRYMMYQQGCFAGGTVLRLAKDLAENNKGSRVLVVCSEVTAITFCGPSDTHLDNLVGQALFGDGAAAVIVGSDPIQEIEKPLFELVWTAQTIAPNSEGAICGQLREFGLSFHLCKDVPDIVSKNIDKALFEAFQPLGISDYNSIFWIAHSGGPAILDKIEEKLALKPEKMSATRKMLSEYGNMSSACVLFILDEMRNKSAQDGLKTTGEGLEWGVLLSFGPGLTIETIVLHSVAI

SEQ ID NO: 22 - protein, 392 aa, Vitis pseudoreticulata
MASVEEIRNAQRAKGPATILAIGTATPDNCIYQSDYADYYFRVTKSEHMTELKKKFNRICEKSMIKKRYIHLTEKMLEEHPNIGAYMAPSLNIRQEIITAEIPKLGKEAALKALKEWGQPKSKITHLVFCTTSGVEMPGADYKLANLLGLDNSVRRVMLYHQGCHAGGTVLRTAKDLAENNAGARVLVVCSEITVVTFRGPSEEALDSLVGQVLFGDGSAAVIVGSDPDISIERPLFQLISAAQTFIPNSQGAIAGNLREVGLTFHLWPSVPTLISENIEQCLTKAFDPLGISDWNSLFWIAHPGGPAILDAVEAKLNLEKKKLEATRHVLSEYGNMSSACVLFILDEMRKKSLKREKATTGEGLDWGVLFGFGPGLTIETVVLHSVPMITN

SEQ ID NO: 23 - protein, 395 aa, Arabidopsis thaliana
MVMAGASSLDEIRQAQRADGPAGILAIGTANPENHVLQAEYPDYYFRITNSEHMTDLKEKFKRMCDKSTIRKRHMHLTEEFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 24 - protein, 447 aa, Helianthus annuus
MLNIRTTIWDPNLPRPPLPLYNKHSTLLFTTITCISQSHFSLLVIEKQLMASSIDIAAFREAQRAQGPATILAIGTATPSNCVYQADYPDYYFRITKSEHMVELKEKFKRMCDKSMIKKRYMHLTEEYLKENPSICEYMAPSLDARQDVVVVEVPRLGKEAAVKAIKEWGKPKSQITHLIVCTTSGVDMPGADYQLTKLLGLRPSVKRFMMYQQGCFAGGTVLRMAKDLAENNKGARVLVVCSEITAVTFRGPSDTHLDSMVGQALFGDGAAAVIVGSDPDLTTEQPLFEMVSAAQTILPDSEGAIDGHLREVGLTFHLLKDVPGLISKNIEKALTQAFSPLGISDWNSIFWIAHPGGPAILDQVEQKLKLKEEKMRATRHVLSEYGNMSSACVLFILDEMRKKSVEDGAATTGEGLDWGVLFGFGPGLTVETVVLHSVPTTRPIVP

SEQ ID NO: 25 - protein, 389 aa, Vaccinium ashei
MVTVEEVRKAMRAEGPATVLAIGTATPAHCVEQATYPDYYFRVTNSEHKAELKEKFQRMCDKSQIKKRYMYLTEEILKENPNVCAYMAPSLDARQDMVVVEIPKLGKEAAVKAIKEWGQPKSKITHLVFCTTSGVDMPGADYQLTKLLGLRPSVKRLMMYQQGCFAGGTVLRLAKDLAENNKGARVLVVCSEITAVTFRGPSDSHLDSLVGQALFGDGAAAIIVGADPIPEVEKPLFEVVSAAQTILPDSDGAIDGHLREVGLTFHLLKDVPGLISKNIEKSLVEAFQPLGISDWNSIFWIAHPGGPAILDQVEQKLALKPEKLRATRHVLSEYGNMSSACVLFIMDEMRKKSAEDGFKTTGEGLDWGVLFGFGPGLTVETVVLHSLCT

SEQ ID NO: 26 - protein, 398 aa, Unknown
  Daucus carota subsp. Sativus
MATPLYSSSLSVDEMMKNQRAKGPATILAIGTAAPPNCYSQAEYPDFYFRVTKSDHKTELKEKFKRICSKTMIKTRYLHITEKTLEENPSMCDYSAPSFDARQEILRMEVPKLGKEAAEKAIKEWGHSKSEITHLIFCTTSGYDMPSADYQLTKLLGLNHSVKRHMIYLQGCFAGGTVLRLAKDLAENNKGARVLVVCAEITTITFRGPHLESLLPQALFGDGASSVIVGSDPDPLTERPLFQIVSSAQHILPDSEDTIRGKLGESGLMFFLKKNITTLIASDIEKLLKEAFEPIGISDWNSLFWITHPGGPAILNQIELVLGLKEEKMWASRKVLSQYGNMASACVLFVLDEMRKKSMKDGMATTGDGLDWGVAFGFGPGLTVETVVLRSIPVTSFT

SEQ ID NO: 27 - protein, 403 aa, Aloe arborescens
MSSLSNSLPLMEDVQGIRKAQKADGTATVMAIGTAHPPHIFPQDTYADVYFRATNSEHKVELKKKFDHICKKTMIGKRYFNYDEEFLKKYPNITSYDEPSLNDRQDICVPGVPALGTEAAVKAIEEWGRPKSEITHLVFCTSCGVDMPSADFQCAKLLGLHANVNKYCIYMQGCYAGGTVMRYAKDLAENNRGARVLVVCAELTIMMLRAPNETHLDNAIGISLFGDGAAALIIGSDPIIGVEKPMFEIVCTKQTVIPNTEDVIHLHLRETGMMFYLSKGSPMTISNNVEACLIDVFKSVGITPPEDWNSLFWIPHPGGRAILDQVEAKLKLRPEKFRAARTVLWDYGNMVSASVGYILDEMRRKSAAKGLETYGEGLEWGVLLGFGPGITVETILLHSLPLM

SEQ ID NO: 28 - protein, 400 aa, Trifolium pratense
MNNIIQMEKRVEKNGEGKSVATILAIGTANPPNFILQCDYPDFYFKDVNINSDDDLQRLKLKFKRICDNTKIEKRHVVVTEEFLKQNTENGNYESLSLEKRLKLPTEEVVKLAKEASLKAIKEWGQPISEITHLIFYTTSCFGSVPGPDSRLAKLLNLKPTVNRLMMFVHGCHAGGTILRVAKDIAENNVGSRVLAVCSETMLASFQTPTSDFNTDILIGHALFGDGAAAMIIGSDPNLSIEKPVFEIVSASQTTVPDTENMIRGQPGQMGRLVYHLDKNLPNIVANNVEKCLIDFFNEDFDWNKLFYAIHPGGPLVLSKVEEKLGLNDEKLKESWGVLNEYGNMWSPTVIFILDEMRKRSKNEGKGTTGEGLEWGVLLGFGPGVAIETVLLHSVSCVNQ

SEQ ID NO: 29 - protein, 399 aa, Hydrangea macrophylla
MATKSVAVEEMCKAQKAGGPATILAIGTAVPSNCYYQSEYPDFYFRVTKSDHLTDLKSKFKRMCDRSSIKKRYMHLTEEILKENPNMCSFAAPSIDGRQDIVVKEIPKLAKEAASKAIKEWGQPESNITHLVFCTTSGVDMPGCDYQLTRLLGLRPSIKRLMMYQQGCHAGGTGLRLAKDLAENNKGARVLVVCSEMTVINFRGPSEAHMDSLVGQSLFGDGASAVIVGSDPDLSTEHPLYQIMSASQIIVADSEGVIDGHLRQEGLTFHLRKDVPSLVSDNIENTLVEAFTPILMDSIDSIIDWNSIFWIAHPGGPAILNQVQAKVGLKEEKLRVSRHILSEYGNMSSACVFFIMDEMRKRSVEEGKGTTGEGLEWGVLFGFGPGFTVETIVLHSVPI

SEQ ID NO: 30 - protein, 385 aa, Cannabis sativa; identical to SEQ ID NO: 5

SEQ ID NO: 31 - protein, 385 aa, Cannabis sativa; identical to SEQ ID NO: 5

SEQ ID NO: 32 - DNA, 1182 bp, Artificial Sequence
  Synthetic
atggttgacataaataccatcagacgtactcagagggcctgcggtgcagctacagtcatggctattggcacggctaaccctccaaactcagtagatcaaatcaattacccagattattacttcagaattactaaaagtgaccacatgaccgagctgaaggaaaagtttaaaagaatgtgtgccaagagcatgatcaagactagatacttgcatctaaccgaagatttattgaagaaaaaccccaaccttggtgcttataaggctccatccttgaacgccagacaagacattttggtggaagaaatcccaaagttaggtaaagaagctgccgttaaggctatacaagaatggggacaacctaaatctgagattactcacttaattttctgttctacaggtggtgtcgacaccccaggtgcagattttcaattgactaagttgttaggtttgcaacttagcgttaagcgttacatgatgtaccaacaaggatgtttctctggcggtatggttttgagattggcaaaggacttggctgaaaataatagaggtgctagagtcctagtagtttgctccgaaattaccgtcctgacctttcatggtccaagttctactaacctagattcgttgcttggtcaggctatcttcggtgacggtgctgctgccgttatcgttggtgcagatcccgtcattggtattgaaaagccattattcaaaattgtttccgcttctcaaactatcatcccagactgtggtgatgccatagatggccacttgcgtgaggaaggtttgatctttcatttacaaaagacggttcctgaattggtaagtatgaacattaaaaaatcactagaagaggctttcgaaccattgggtatctccgactggaactccttgttctggatagtccacccaggaggacctaagattctgaatcaagtggaattaaagttgaaccttgaaccagaaaagttggctttgtctaggcacgttttgtccgaatatggtaatatgtctggtgcctgtgtcttgtttgtgctagataagatgagaacgaagtctgttcaagagggtctgcaaacaaccggtgaaggcttagaatggggtgttctttttggtttcggtccaggtttaactgtcgaaactttggttttgcactcggttttgattcatgataactcctaa

SEQ ID NO: 33 - DNA, 1179 bp, Artificial Sequence
  Synthetic
atggccttcatggaagagattaggaatgctcaacgtgcaaagggtcctgctaccgtcttggctatcggcacggccactccagataactgcttataccagagcgactttgcagactattacttcagagttacaaaatctgaacacatgactgaactgaagaaaaagtttaacagaatatgtgataagtcgatgattaaaaagagatacatccatttgacagaagaaatgttggaagagcacccaaatattggagcttatatggctccctcccttaacatccgtcaagaaattatcaccgccgaagtaccaaagctaggtaaggaagctgctttaaaagctttgaaggaatggggtcaaccaaaatcaaagatcacccatttagttttctgtactacttccggtgtggaaatgccaggtgccgactacaagctggctaacttgttgggtttggagccttctgtcagaagagtcatgctttatcaccaaggttgttacgctggtggtacggttttgagaaccgcaaaggatttggctgaaaataacgcaggcgccagagttttagtagtttgctctgaaattactgtcgttactttcagaggtccatcagaagatgctttggactctctggtcggtcaagctttgtttggagatggtagcgctgccgttattgtcggttccgaccctgatatatctattgaaaggcccctattccaattagtttcagccgctcagacttttatcccaaatagtgccggtgctatcgctggaaacttgagagaggtcggtttaaccttccatttgtggccaaatgttccaactctaatttccgaaaacattgaaaactgtttgactaaggcatttgacccaattggtatatctgactggaactcgttgttctggatcgctcacccaggtggcccagccattttggatgctgttgaggctaaagtaggtttggataaacaaaagttaaaggctaccagacacatcttatctgaatacggtaacatgtcctctgcctgtgtcttgttcatcttggacgaaatgcgtaagaagagtctaaaggaaggaaagaccacaaccggtgaaggtcttgattggggtgtgttgtttggcttcggtccaggtttaacaatcgagactgttgtccttcacagcgtgggtaccgattctaactaa

SEQ ID NO: 34 - DNA, 1185 bp, Artificial Sequence
  Synthetic
atggttatgggcgctctttcgctagatgaaatacgtaaggcacagagaggtgacggtccagcctccattttagctattggaaccgctaatcctcccaaccaagtcatccaagccgagtacccagattattacttcagaatcacaaactctgaacacatgacggacctgaaagaaaagtttaagaggatgtgtgacaaaagcatgattaagaaaagatacatgcatttgactgaagagttcttgaaggataacccaaatgtgtgcgcttttatggctccaagtttggacgttagacaagatatcttggtagccgaagttcctaagttgggtaaagaagctgccgtcaaggctattaccgaatggggtcaaccaaagtctaagattactcacttagttttctgtactacctccggtgttgatatgccaggtgcagattatcagctaatcaagttgttaggtctttgtccttctgtcaaaagagtcatgatgtaccatcaaggctgctacgctggtggtaccgttttgagagttgctaaagacatagccgaaaacaaccgtggtgcaagagtattgattgtctgttcagagatcactgtggtgacattcagaggtccatctgaaactcacttagattccttggttggacaatcattgtttggtgacggagctgctgctctgattgtaggttcagatccagacacttctgttggtgaaaagcccatattcgaaatggtttctgccgctcaaaccatcctaccagactcccaaggcgccatcgaaggtcatttaaaagaagtcggcttgaccttccacctattaaagactgtcccaggattgattagcaagaatatcgaaaagtgtctggaagaagcttttaagcctcttggtatttccgactggaatagtttattctggattgctcacccaggtggtccagccatattggatcaagttgagattaagttgggtttgaaacctgagaagatgaaggctactaggcatgtcctttctgaatatggtaacatgtcctctgcatgtgttttctttatcttagatgaaatgagaagaaaggcagtcgaagatggtgctgaaacgacaggtgaaggtttggaatggggtgttttgtttggatttggtccaggtttaactgttgaaaccgtggttttgcattcagttccattgtaa

SEQ ID NO: 35 - DNA, 1197 bp, Artificial Sequence
  Synthetic
atgacaaccggcaaagtgacgttggaagcagttcgtaaggcccaaagagctgagggtcctgctactgtactagctatcggaactgccaccccagctaattgcgtctatcaggctgattaccccgactactattttagagtcactaagtcggaacatcttaccgatttaaaggaaaaattcaagagaatttgtcacaaatcaatgataagaaagaggtacatgcacttgactgaagacattttggaggaaaacccaaacatgtcctcttactgggccccatctttagatgcaagacaagacatcttgattcaagaaatcccaaagctaggtgctgaagctgctgaaaaagcattgaaggaatggggtcaacctcgtagcagaataacgcatttggttttctgtaccacttccggtgttgacatgccaggtgctgattatcaactgattaagcttttgggtctgtgtccatctgttaacagagccatgatgtaccaccaaggttgtttcgctggtggaatggtccttagattagctaaggatttggccgaaaataacaggggtgctagagttttgattgtttgcagtgagatcacagtcgtcacttttcgtggtccctctgaatctcacttagactccttggtgggtcaggcattgttcggtgatggcgctgccgctgttattgttggtgctgacccatcagaaccagcagaaagacctttatttcatttggtgagtgcttctcaaactatcctgccagactccgaaggtgctatcgagggtcatttgcgtgaagtcggtttgacattccacctacaagatagagttccacaacttattagcatgaacattgaaagattgttggaggatgctttcgcccctttgggcatatctgattggaatagtatcttttgggtcgctcacccaggtggaccagctatcttaaatatggtcgaagccaaggtaggtcttgacaaagccagaatgtgtgcaaccagacatattttagctgaatatggtaacatgtcctctgtttgtgttttgtttattttggacgaaatgagaaacagatctgccaaggatggtcacaccactaccggagaaggtatggagtggggtgtgttattcggtttcggtcccggtctaactgttgaaacaatcgttttacacagtgtcccaatcacaactgttgcagcttaa

SEQ ID NO: 36 - DNA, 1158 bp, Artificial Sequence
  Synthetic
atgaatcaccttagagcagagggtcctgctagtgtgttagccataggcaccgctaacccagaaaacattctgttgcaggatgaatttcccgactactatttccgtgtcactaagtccgaacatatgacgcaactaaaagaaaagttcagaaaaatctgcgataagtcaatgattaggaagagaaactgttttttgaatgaggaacacttgaagcaaaacccaagattggtagaacatgaaatgcaaacattagacgctcgtcaagatatgttggttgtcgaggttccaaaattgggaaaggatgcctgtgctaaggcaatcaaagaatggggtcaaccaaagtctaagattactcatcttatcttcacctctgcttccactactgacatgcctggtgctgactaccactgtgccaagttattgggtctatccccatctgttaaaagagttatgatgtatcaattgggttgctacggtggcggtaccgtgttgagaattgctaaggatatagccgaaaataacaagggtgctagagtcttagctgtttgttgtgatatcatggcctgtctattcaggggaccaagcgaaagtgacttggaactattggtcggtcaggctatctttggtgacggtgctgccgctgttattgtgggtgctgaaccagatgaatctgttggtgaaagacctattttcgaactggtcagcacgggtcaaaccattttgcccaactctgaaggtactatcggaggtcacataagagaagctggtttaatctttgatttgcacaaagacgttccaatgcttatttcgaacaatattgagaaatgtctaatcgaagccttcactccaatcggtatcagtgactggaactctattttttggattacacacccaggtggtaaggcaattctggataaggttgaagagaaattgcatttaaagtccgacaagttcgtcgattcaagacacgtattatctgagcatggaaacatgtcctcatctaccgttttgtttgtcatggatgaattgcgtaagcgttctttggaagaaggtaaaagtactactggcgacggtttcgaatggggtgtcttatttggatttggtcctggtttaactgttgagagagttgttgtaagatccgtcccaatcaagtactaa

SEQ ID NO: 37 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 38 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 39 - DNA, 1185 bp, Artificial Sequence
  Synthetic
atgccaggattagagaatagaaaaaaggtggaagcccctaagcgtgcagaaggtctagctactatcctggctattggtagagctaacccacccaacgccatggaacaaagcacgtttcctgacttctacttcagagtaaccaactcagaacacttggttggtcttgagaagaaatttgaaaggatatgtgaaaagactgctattagaagacgtcatttcgtttggaatggcgaaatcttaaacgcaaatccatgcttgagaacccacatggaaccatctttgaacgtcagacagaagattgctgttgctgagatcccaaaattgggtgccgaagctgctagtagagctatcgaagaatggggtcaaccaaagtcccatattactcacttgatcttctgtacaacttcgggtatggatttgcctggtgccgattataagcttaccagaattttgggattaaatccaaacgtccaaagggttatgttataccaacaaggttgttttgctggaggtacagtcttgagattggccaaatgtttcgccgaatctcagaagggtgctagagttctggtcgtgtgctccgagactaccacggttttagtccgtgctccatctgaagactatcaagatgacttagttactcaagcactatttgctgatggtgcatctgctctaatcgtaggtgctgatccagacgaagaagctaaggaaagaagaattttcaccatcgtcagcgccacccaagtcatattgccagattcggacggtgccattggtggccatttgggtgagggtggtttgactgctacattgcacagagatgttccccttattatttctaagaacgtttccaaatgtttggaagaagcctttgctccactaggaatatcagactggaatagtatattctgggctcctcacccaggtggtagagctatcttggaccaagttgaagaaagagtcggcttgaaaccagagaagttgtgggcatctcgtcacgtactggctgaatacggtaacatgagctccgtttgtgtccatttcgttttagatgaaatcaggaagagatccaccaaagaaggtaagaccactaccggtgagggttttgactggggtgtattgttcggctttggtccaggtttgactgtcgaaacggttattttaagatctgttccattaaactaa

SEQ ID NO: 40 - DNA, 1185 bp, Artificial Sequence
  Synthetic
atggttatgggtgccctttctttagatgagatccgtaaggcacaaagagctgacggcccagcttccattctagctataggtacagctaacccccctaatcaggtaattcaagccgaatacccagattattactttagaatcaccaacagtgaacatatgactgacttgaaagaaaagttcaagagaatgtgcgacaagtcgatgattaggaaaagatacatgcacctgactgaagagttcttgaaggataatccaaacatctgtgcttttatggctccatctttggacgtcagacaagatatcttagttgcagaagtccctaaattgggtaaagaagccgctgttaaggctattacggaatggggtcaaccaaaatccaagataacccacttagttttctgtactaccagcggagtcgacatgccaggtgccgattatcaattgattaagttgttgggtctatgtccatctgtgaagagagttatgatgtaccatcagggttgctatgctggcggtacagtcctacgtttggccaaggacatagctgaaaataacagaggtgcaagagtattaatcgtttgttcagagatcactgttgtcacctttagaggtccttcggaaacccacttggattctcttgtcggacaatccttattcggtgatggtgctgctgccctgattgtcggtagtgacactgacacttctgttggcgaaaagccaattttcgaaatggtatcagctgctcaaaccattttgccagattctcaaggtgcaatcgaaggtcatttgaaggaggttggtcttactttccacctgttgaaaacggttcctggtttgatttcaaagaacattgaaaaatgtttggaagaagcctttaaaccccttggcatatccgactggaactccttgttctggatcgctcacccaggtggtccagctatcttggatcacgtcgaaattaagctaggtctaaagccagaaaagatgaaagccaccagacatgtgttatctgaatacggtaacatgtctagtgcttgtgttttctttattttggacgaaatgagaaggaaggctgtcgaggatggtgcagaaaccactggcgaaggtttggaatggggtgttttatttggtttcggtcctggacttacggttgaaacagttgttctacactcggtccctttgtaa

SEQ ID NO: 41 - DNA, 1191 bp, Artificial Sequence
  Synthetic
atgtctgctgagatgacagtcgatcttgaaacgtttagaaaaacccaacgtgccgacggcccagctagtatattagcaatcggtactgctaaccccccaaatgccgtacaccagtcgacctatcctgattactacttcagaattacttcaggagaacaaaacactgacctgaaggataagttcaagaggatttgcgaaaaaaccgctatcaagaagagatacatgtatctaactgaagagatcttgaaaaagaatccaaacatgtgtgcttttatggaagtgccatccttggacgttcgtcaagccatgttgttggttgaagtccctagattaggtaaggaagctgctgataaggcccttcaagaatggggtcaaccaaaatctaaaattacacatttgatcttctgttctaccactactgccgacattccaggtgctgattgtgaagttgctaagttgttaggtttgcacccatccgtcaagagagttggtgtttttcaacatggctgtttcgctggtggtacggttttgagattggcaaaggacgtcgcagaaaacaatagaggtgctagggtgttagtggtctgctctgaaataactgctgtaacctttagaggtcctagcgacacacacctagattcgttagttggtcaggccttgttcggtgatggcgctgctgcccttattgttggtgcagacccaattcctcaagttgagaaaccatccttccaaatcgcttggaccgctcaaactatcttgccagatagtgacgatgctatatcaggtaaggtcagagaagttggtttgacgttccatctgaagggagccgtcccagacttgatttctactaacattgagaactcactggttgaagcattcagacaatttaaaatctctgattggaaccagttgttttggatagctcaccccggtggtcgtgctattttagatagagtcgaagctaagctaaatttggacccaggtaagcttagagcaaccagacacgtcttgagtgaatacggtaatatgtccagcgcttgtgttcatttcatccttgatgaaatgcgtaagacatccagagagaatggctattctactaccggtgaaggtttagaaatgggtgtattgtttggatttggtccaggtttgaccgttgaaactgtagtcttaaagtctgtcctattaccataa

SEQ ID NO: 42 - DNA, 1191 bp, Artificial Sequence
  Synthetic
atgtccgtaggcatgggagttgacttagaggcttttaggaaaagtcaaagagccgatggtttcgcttcaatactggcaatcggtacagctaaccccccaaatgtcgtggaccagtctacctatccagattactacttccgtaacactaacaatgaagataacactgacttgaaggacaagtttaagagaatttgcgaacgttctgccattaaaaagagacacatgtacttgaccgaagaaatccttaaaaagaatcctgaactatgtgctttcttggaggttccatccttggatacgagacaagctatgttagccgtcgaagttccaagattgggtaaggaagctgctgaaaaggcaattgaagaatggggtcaaccaaaatcgagaatcactcatttgatcttctgtaccactactacccctgatcttccaggtgccgactttgaagtcgctaagttattgggcttacacccttctgttaagagagttggtgtgtttcaacatggttgtttcgctggtggtacagtcttgagattagcaaaggacttggctgaaaacaacagaggagctagagttctagttgtttgtagcgagaacacggctgtcacattcaggggtccatctgagactcacttggatggtcttgttggtttggcactgttcggtgacggtgctgccgccttgattgttggtgctgatccaatccctcaagtagaaaagccatgctttgaaattgtctggaccgcccagactgtcgttccaaattctgacggcgctatttccggtaaattacgtgaagttggtttgaccttccaactaaagggagctgttcctgatttgatttccacaaatatagaaaagtgtttggtcgaagctttcagtcaattcaatatcagcgactggaaccaattgttttggatcgctcacccaggcggtagagccatactggatcaagttgaggcttcattaaacttagatcccactaagttgagagccaccagacatgtcatgtcagaatatggtaacatgtcttctgcatgtgtacactttattttagacgagactaggaaagcttccagacaaaacggttgttctacttccggtggaggtttccaaatgggtgttctatttggtttcggtccaggtcttactgtagaaaccgttgtcttgaaatccattccattcccataa

SEQ ID NO: 43 - DNA, 1170 bp, Artificial Sequence
  Synthetic
atggtctcggtaagcgaaatacgtaacattcagagggccgagggacctgcaaccgttcttgctatcggtacagctaatccatcaaactgcgtggaccaatccacttatgctgattactactttagagttacggattctgaacacatgactgacttaaaaaagaagttccaaagaatttgtgaaagaacccaaatcaagaacagacatatgtatctgactgaagagattttgaaagaaaatccaaatatgtgtgcttacaaggccccctccctagacgctagagaagatatgatgatccgtgaagtcccaagagtgggcaaagaagcagccaccaaggccatcaaggaatggggtcaaccaatgtctaagattacccacttgatattctgtactacctctggtgttgctttacctggtgtcgattacgaattgattgttttgttgggtctggacccatgtgttaaaagatatatgatgtaccatcaaggttgctttgctggaggtactgtcttgagactagctaaggatttagctgaaaactctaaagacgcaagagttttgatcgtttgtagtgagaacacagctgttactttcagaggtccaagcgaaactgatatggattccttggtcggtcaagccctttttgctgacggtgctgctgctattatcattggttctgaccctgtaccagaagtcgaaaagcccattttcgaaattgtttccacagatcaaaagttagtcccaggatcacacggtgccatcggtggtttgttgcgtgaagtcggcttgaccttttatctaaacaagtctgttccagatatcataagtcaaaacataaatgacgccctgtccaaagctttcgatccactgggtatatctgactacaattcgattttctggatcgctcaccctggcggtagggctattttagaccaggttgaacaaaaagtcaacttgaagccagagaagatgaaagctactagagatgtactgagtaactacggtaatatgtcgtctgcctgtgtgttctttatcatggatttgatgagaaagaagtctttggaagagggtctaaagacgacaggtgaaggtcttgactggggtgttttatttggtttcggcccaggtcttactattgagactgtggttttgagatccgttgcaatttaa

SEQ ID NO: 44 - DNA, 1296 bp, Artificial Sequence
  Synthetic
atggcttctttgtgtcatattccttttcaaaaacagatgtccaattgcagaacggtccacccaatattcggtcaaaagagtcgtcttctgatcaagaacctagccaaatcattcgttccagctaagacagcaaccgtggaagagatcaggagagctcaaagagccgaaggacccgctactgttttagctattggcaccgctactccatctaactgtttttaccaatgtacttatccagactacttcttcagagtaactaatagcgaacacaagactaagttgaaggaaaaatttaagcgtatgtgcgatggttcgatgattaaaaagagatacttgcatttaaccgaagagatcttgaagaagaaccctaatatctgtgaatataaggcttcctctttcgatgccagacaagaaattgcaattgtcgaagttccaaaattgggtcaggaagccgctgaaaaggctatcaaagaatggggtcaatctaagtccaaaataacccacctggttttttgtacaactacaagtgtcgagattccaggtgcagactaccaattgaccaagcttttaggtttggatccttctgttaaaagattgatgatgtatcaacaaggttgtttcggcggtggatcgtctttgagattagctaaggacctagctgaaaacaacaagggtgcaagagttttggtcgtttgtagcgagattactgtgttgtcctttcacgctccatccgacaccgaactagatgtcttggtcggtcaagctctattctcagacggtgccagcgccgttatcgtaggttctgatccaattttaacagttgaaagacctttgttcgaaatcgtctttgctacgcaaacgttgttaccagactctggtcatgcaatttacggaaacttatgtgaatctggtttggtggctcacatgcataaggatgttccaatcctggtatcaaaggacatcgagaagatcatagaagaagtttttcgtcctttgggtatttccgattggaatagtattttctgggtagcccatgctggtggtagagccatcttggatcaaattgaagtcaaattaggcctaaaaccagaaaaattgcgtgctgctagacacgttatgtctgagtatggtaacatgggttctgcttgcgttctattcgtccttgacgaaatgagaaaggcttcaattaaggaaggtttgggtaccactggcgaaggtttggagtggggtgccctttgtggttttggtccaggtcttactatagagactatcgttttgcactcaatttccatttaa

SEQ ID NO: 45 - DNA, 1197 bp, Artificial Sequence
  Synthetic
atggctgccaaagttactgtcgaagaggtaagaaaggcacaacgtgctgaaggaccagcttctgttttagcaataggtacggtgacacccccaaactgcgtctaccaggctgattatgccgactactattttagggttaccaagagcgaacatatgaccgaacttaaggaaaaattcaagagaatctgtagaaaatccatgattcaaaagagatacatgcacctaactgaggatatcttgttggaaaatccaaacatggcttcatacagtgctccttcgttgaacgccagacaagccattttagtcgaagaagttccaaagctgggcgctgctgctgctgaaaaagcattgaaggaatggggtcaaccaaggtcccaaattactcacatcatattctgtactaccagtggtgttgacatgcctggtgccgattctcgtatcattaagctattgggtctggacccatctgttaagagagtcatgttataccatcaaggttgttttgctggtggaatggttttgagaattgctaaagaccttgccgaaaataacagaggtgctagagtcttaattgtgtgttctgaaatcacagtcgttaccttcagaggcccatccgaggctcacttggattctttggtcggtcaagctctattcggtgatggtgcagccgctgttattgtgggtgcagatcctgacgagcacgttgaaagaccattgtttcagatggttagcgcttcagaaacgatcttgccaaattccgacggtgccatagaaggtcatttaagggaagtcggtttaactttccacttgcaagaaagagttcctgagttgattagttctaacatcgaaagattgttggaagaatcttttaagccacttggcatttcggactggaactcaattttctgggtagctcaccccggtggtccagctatccttaacgccgttgaatccaaggctggaatcgataaggctcgtttaagagctactagacaagtattgtctgaatatggtaatatgtcttccgcctgcgtattgttcattttggatgaaatgagaaagtttagtgctgaagacggtcgtgcaaccacaggtgaaggtatggactggggcgtcctattcggttttggtccaggtttaaccgtggagactgttgtcttacattcagtccccattactaccggtcacgctgcttaa

SEQ ID NO: 46 - DNA, 1173 bp, Artificial Sequence
  Synthetic
atgccatctttagagagcataaaaaaggctcctcgtgcagatggtttcgctagtattcttgccatcggaagagctaacccagacaatatcattgaacaatctgcctaccccgatttttatttcagggttactaactcggaacacctagtcgacttgaagaaaaagtttcagagaatctgcgaaaagaccgctattagaaaaagacatttcgtatggaatgaagaatttttgacggctaacccatgtttctcaacattcatggataagtccctgaacgttagacaagaagtggctatctccgaaattccaaagttaggtgctaaggccgctactaaagccatagaggactggggtcaacctaagtctcgtattacccacttgattttttgtactacctctggtatggacttgccaggcgcagattaccaactaacacaaatcttgggtttgaatccaaacgttgaaagagtcatgttataccaacaaggttgtttcgctggaggtactaccctgagacttgcaaagtgtttggctgaatccagaaagggtgcccgtgttttggtcgtttgcgcagaaaccactactgttttgtttagagctccaagtgaggaacatcaggatgaccttgttactcaagccttgttcgctgatggtgcttctgctgtcatagtgggtgcagacccagatgaagctgctgacgagagagcatccttcgtcatcgtgtccacatctcaagtcttattgcctgactcagctggtgctattggcggtcacgtttcagaaggtggtttattagccacgttacatagggatgttccccagatcgtcagcaagaatgtaggcaaatgtttggaagaagcctttaccccatttggtatttctgattggaactctatcttctgggttccacaccctggtggaagagctattttggatcaagtggaagaaagagttggtttgaagccagaaaaattgagtgtatccagacacgttctagccgaatatggtaatatgtctagcgtctgtgttcatttcgccttagatgaaatgagaaaaaggtccgctaacgaaggtaaggccacaactggtgagggtttggaatggggcgtcctttttggtttcggtccaggtttgaccgttgaaactgtcgtcttgagatctgttcctttgtaa

SEQ ID NO: 47 - DNA, 1170 bp, Artificial Sequence
  Synthetic
atggtttcggtgtcaggcatccgtaacgtcgaaagggccgagggaccagctactgttctagcaattggtacggctaatccttctaactgtgttgaccagagcacatatgctgattactacttcagagtcaccaattctgaacatatgactgaccttaaaaagaagtttcaaagaatatgcgaaagaacccaaattaagaacagacacatgtatctgactgaagaaatcttgaaagaaaacccaaatatttgtgcctacaaggcaccctccttagatgctagagaagatatgatgatccgtgaggtaccaagagtcggtaaggaagctgctaccaaagccataaaggaatggggtcaaccaatgtccaagattactcacttgattttctgtactacctctggtgttgctttgcctggtgttgactacgaattaatcgtcttgttgggtttagatccatgtgtcaaaagatatatgatgtaccatcaaggctgctttgccggtggtacagttttgagactggctaaggacttggctgagaacaacaaggatgccagagtgttaatcgtttgttctgaaaacacagctgttactttcagaggaccaagtgaaaccgacatggactccttggtaggtcaagccctttttgctgatggtgctgccgccattatcattggtagcgaccctgtaccagaagtcgaaaagccattgttcgaaatcgtttccactgatcaaaaattagttccaggttctcacggtgcaattggtggcttgttgcgtgaagtcggtctaaccttttaccttaataagtctgtcccagatattatatctcagaatatcaacgacgctttgtctaaagctttcgaccccttaggtatctcggattataattccatattctggattgcacaccctggtggaagagcaatcttggaccaagttgagcaaaaagttaacttgaagccagagaagatgaaggctacaagggatgtcctttcaaactacggtaacatgtccagtgcttgtgttttcttcataatggatctaatgaggaagaaatcattggaagaaggtctgaaaaccacgggcgaaggtttggattggggtgtcttgtttggttttggtccaggtttgactattgaaaccgtggttctgagatctgtcgctatctaa

SEQ ID NO: 48 - DNA, 1179 bp, Artificial Sequence
  Synthetic
atgtctatggagaacgttgaagctttcggcaaagcacagcgtgccgacggtcaagcttccattttagctataggtaccgccaatccacctaacatcgtctatcaatcgacatttccagattactacttcggtattacgaataacgaacacaagatcgatctaaaggaaaagtttagaagaatttgcgaaaaaagtatggtgactaagaggcatatgcaccttactgaagagatcttgaaggaaaaccccaatatgtgtgcttatagagcaccatctatggacagcagacatgatataatcagagaagaagttccacgtttgggaaaagaagctgctgtcagagccattaacgaatggggtagatccaagtctgaaattacccacttggttttctgtactacctcaggtgtagacatgcctggtgctgattaccaactgatgaggttgttaggtttgcgtccatctgtcaagagagttatgttatctcaccaaggttgtttcgccggaggaacagtgcttagattggctaaagatttggctgagaataacagaggtgctagagttttagtcgtctgtagtgaaactaccgccgttacttttagaggcccagaccatacgagatttgacaacttggttggtcaagcactattcgctgatggtgctgctgcattggtagttggtgccgacgctgtgcaaggtcttgaaaccccctgttttcacctgttgtggaatgctcagactattttgccagagtccgaaggtgccatcgaaggtcacttgagagaagtcggtttaactttccaactattgcattctgttccacagttgatttcagataacatcgaagctgccttaaaggaagctttcagacactccggtgttagcgattggaacgacttattctggattgctcatcctggaggtccagctattctggacgcagtagagtcaaagctacaacttgatccaaagaaattgcgtgctacccgtcacgttttgtctgaatacggtaatatgtccagtgctagtgtcctatttgttttggacgagatgagaaagggttccagaagaggtggttgcgctaacacaggtgaaggtttggatttgggcgtcttattcggttttggtcctggattaactgtcgaaactgttgttttgagatctgtgaggcttcaataa

SEQ ID NO: 49 - DNA, 1182 bp, Artificial Sequence
  Synthetic
atggctcacctagaagagattagggaaaaacaaagagcaagaggcccagctaccatattggccatcggaacagctacgccttcgaattgtatttatcagtctgatttcactgactactactttcgtgttaccaagagtgatcatatgactcaacttaaggccaagctgaaaagaatctgcgaaaagtccatgattgaaaagagatatatccacttaactgaagaaatgttgaaggaaaacccaaacattggtgcttacgaggaaccctcattggacgtcagacaagatatcttagtagaggaagttccaaaattgggtgaaaaggctgctagcaaagcattgaaggaatggggtagaccaaggtctgacataactcatttaattttctgttccacctctggtgtggacatgccaggtgccgattaccaattgctacgtttgttgggtctgaagccttcaaccaagagatttatgttgtaccaccaaggttgttacgctggtggtactgtcttaagattggctaaagatttggctgaaaacaatgttggtgctagaatccttgttgtctgttctgagatcacagtcgtgactttcagaggcccatgtgaaacacatctggatagtctagttggtcaagctttgttcggagatggtgcctcctctgttattgttggttctgacccagacacctcaatagaaagaccattatttcacttggtcagcgcctccgaaaccattttacctaattctgaaggtgctatcgaaggccatctacgtgaagttggtttgactttccaccttaaggacaacgttcctcaattgattggtgaaaacatcgaaaagtcccttgaggaagcttttcacccattgggtatttctgattggaactccttgttctgggtagctcatccaggtggcccagccatattaaaacagatcgaggccacgttgggtttgaacccagacaaattaagagctactaagcaagtcctgaaggaatatggtaatatgtcttcggcttgcgtcttgttcatacttgatgaaatgagaagttggtctttagaaaagggtaagtcctcaaccggtgaaggactgaagtggggtgttttatacggttttggtccaggcttgaccatggagactatcgttttacactctgctgctgtcgatcctaacaattaa

SEQ ID NO: 50 - DNA, 1179 bp, Artificial Sequence
  Synthetic
atggcatccgtcgaagagtttagaaacgcccagagggctaaaggtcctgctacaatcctagctattggaactgctaccccagaccactgcgtgtatcaaagcgattacgccgattactatttccgtgttaccaagagtgaacatatgacggaattgaagaaaaagttcaatagaatatgtgacaagtcaatgattaagaaaagatacatccaccttactgaagaaatgttggaagagcatccaaacattggtgcttacatggctccctccctgaatatcagacaagaaatcattactgctgaagttcctaagttgggcaaggaagccgccttaaaagcactaaaggaatggggtcaaccaaagtctaagatcacacacttagtcttttgtaccacttctggtgtagagatgccaggtgctgactataagttggctaacttgcttggtctggaaacttcggttagaagagttatgttataccaccaaggttgttacgctggtggaacagtcttgcgtaccgccaaagatttggccgagaataacgctggtgctagagtcttagttgtttgctctgaaattaccgtcgtgactttcagaggtccatctgaagacgcccttgattccttggttggtcaagctttgttcggtgacggtagcgcagctgttatcgtaggctctgatccagatgtctcaattgaaagacctttgtttcaattagttagtgctgcccagaccttcattccaaactccgctggtgctatagccggcaacttgagagaagtcggtttaacctttcatttgtggccaaatgttccaacgctgatttccgaaaacatcgagaagtgtttgtctcaagctttcgaccctttaggtatttcagattggaatagcttgttttggatcgcacatcccggtggcccagcaattctggacgctgtcgaagctaaattgaatttggaaaagaaaaagttagaagctactaggcacgtcttgtctgagtacggtaacatgtcttcagcttgtgttttattcatactagacgaaatgagaaaaaagtctttgaaaggtgaaaacgcaactaccggtgaaggtctggattggggtgtgttgtttggattcggtccaggtctgacaatcgaaactgttgtactacactcgatcccaacggttactaactaa

SEQ ID NO: 51 - DNA, 1188 bp, Artificial Sequence
  Synthetic
atggtcatgggcgatatgccatctttagacgaaattcgtaaggctcagagagcagatggtcctgctggaatacttgccatcggtacggctaatcccgccaactacgttatccaagctgagtatccagactactatttcaggattactaactcagaacatatgacagacctgaaagaaaagtttaagagaatgtgcgataaaagtaccatcagaaagagacacatgcacgtgactgaagagttcttgaaagaaaatccaaacatgtgtgcctacatggctccaagcctagacgctagacaagatatagttgtagtcgaagttcctaagttgggtaaggaagctgccgtcaaagcaattaaggaatggggtcaaccaaagtctaagattacccatttggttttttgtactacctccggtgtagatatgcctggtgctgattaccaattgactaagctgttgggtttaaggccatctgttaaaagactaatgatgtaccaacaaggctgtttcgctggtggaacagtcttgagacttgctaaagacttggcagagaacaatagaggtgctagagttttagtcgtttgttccgaaatcaccgcagttacgttccgtggtccatcggacactcacttggattctttggtgggtcaggctctttttagtgacggtgctgccgctttgattgtcggatctgatccagacacttcggttggtgaaaagcccattttcgaaatggtttccgctgctcaaaccatcttaccagactctgatggtgccatagatggtcacttgagagaagttggcctaacttttcatttattgaaggatgtcccaggtttaattagtaaaaacatcgagaagtcattggacgaagcctttaagcctctgggtatctccgattggaatagcattttctggattgcccatccaggtggtccagccatcttggatcaagttgaaattaagttgggactaaaggaagaaaaaatgagagctacaagacacgtaatgagggaatatggtaacatgtcctctgcttgcgttttgttcatcttagatgaaatgagaaagaagagcgccaaagacggtgtcgctaccactggtgaaggtcttgaatggggtgttttattcggatttggtcccggtctgactgttgagacagtcgtattgcattctgttccactttaa

SEQ ID NO: 52 - DNA, 1170 bp, Artificial Sequence
  Synthetic
atgatgaaggtcagcgaaatccgtaaagcccagagagctgagggccccgctaccatattggcaattggtacagctaacccaccaaattgcgtggaacaatccacgtaccctgatttctattttagggtaactaactcggaacacaagattaagttaaaagaaaagttccaaagaatctgtgacaagaccatgattaagagaagatacatgtatcttactgaagagatcctgaaagaaaatccaaacctatgtacttacatggccccatctttggacacccgtcaagatatggttgttgttgaagctcctagattgggtaaagaagctgctgtcaaggcaattaaagagtggggtcaaccaaagtctaagatcacccatttgatattttgtactatttcaggagttgatatgccaggtgccgactaccaacttacgaagttattgggtttgaggccatgtgtcaagagatatatgatgtaccagcaaggttgtttcgctggtggtactgttttacgtctagctaaagacttggctgaaaacaataagggttccagagtgttggtcgtttgctctgaagtcaccgcaattactttctgtggaccaagtgatacacacctagacaacttagttggtcaagcattgtttggtgatggagctgccgctgttatagtaggttctgaccccatccaagaaatcgaaaagcctttgttcgagttagtctggacagctcaaactattgccccaaactccgagggtgctatttgcggtcaattgagagaatttggtctgtcgttccatttgtgtaaggatgtaccagacatcgtgtcaaaaaatattgataaggccttatttgaagcttttcaacctttgggcatttcagattataactctatcttctggatcgcacactccggcggtccagctatcttggataagatcgaagaaaagcttgctttgaaacctgaaaagatgagtgccactagaaagatgttatctgaatacggtaacatgagttccgcttgtgttttgttcattctggatgaaatgagaaataaatctgcacaagacggtttgaaaaccacgggtgaaggtttagaatggggtgttctgttgtccttcggacccggcctaacaattgaaactattgtcttgcattctgtggccatataa

SEQ ID NO: 53 - DNA, 1179 bp, Artificial Sequence
  Synthetic
atggcaagtgttgaggaaatacgtaacgctcaaagagccaagggacccgctactattctagctatcggcacagccaccccagacaattgcatttaccagagcgattatgctgactactatttcagagtcactaaatccgaacatatgacggaacttaagaagaaatttaacaggatctgtgaaaagtctatgatcaagaagagatacattcacttgaccgaaaaaatgttagaagaacaccctaatataggtgcttacatggccccatcattgaacattagacaagaaatcattactgctgagatcccaaagctgggtaaagaggctgctttgaaggcattgaaagaatggggtcaaccaaagtctaagattactcatttagtattctgtaccacatctggtgttgaaatgcctggtgcagattataagttggctaatctgttgggtttggacaactccgtcagacgtgtgatgttataccaccaaggttgtcatgctggtggtaccgttcttagaacggccaaggatttggctgaaaacaacgccggcgctagagttttggtagtctgttcggaaataactgttgtcacttttagaggtccatcagaagaagctttagactccttggtaggtcaagttctattcggcgatggttctgctgctgtcatcgttggatcagacccagatatttccattgagaggccactattccagctaatctctgctgcacaaactttcatacctaattctcaaggtgccatcgccggaaacttgagagaagttggtttgacatttcacttatggccatctgttcccacccttatttctgaaaatatcgagcaatgcttgaccaaagcttttgatccattgggtattagcgactggaactctcttttctggatcgcccacccaggtggtcctgctattttagacgctgtcgaagccaagcttaacttggaaaagaagaaattggaagctaccagacatgtgctttccgaatacggtaacatgagctccgcctgtgtattgttcattttggatgagatgcgtaaaaagtccttaaaacgtgaaaaggcaactacaggtgaaggtctggattggggtgttttgtttggcttcggtccaggtttgactatcgaaactgtcgttttacactcagtcccaatgattactaactaa

SEQ ID NO: 54 - DNA, 1188 bp, Artificial Sequence
  Synthetic
atggttatggctggcgcatctagcttagacgaaatcaggcaggcccaaagagctgatggtcctgctggtatattggccattggtactgctaacccagagaatcacgtgctacaagctgaataccccgactattacttccgtattacaaacagtgaacatatgaccgatttgaaagaaaagtttaagagaatgtgtgataagtccacgatcagaaaaagacacatgcatcttactgaggaatttttgaaggaaaacccacacatgtgcgcatatatggctccttcactggacactagacaagacattgtagtcgttgaagtcccaaaattgggaaaggaagccgctgttaaggcaatcaaggaatggggtcaaccaaaatccaagattacccatgtcgttttctgtaccacttcgggtgttgatatgccaggtgctgattaccaattaacaaagttgctaggattgcgtccatctgtgaagaggttaatgatgtaccagcaaggttgtttcgctggtggcaccgtattgagaatcgccaaagatttagctgagaataacagaggtgccagagtcctggttgtctgctctgaaataactgctgttacatttcgtggtccttctgacactcacttggactccttggtgggtcaagctttgttctcggacggtgctgctgctcttattgttggttctgatccagataccagtgttggtgaaaagccaatctttgaaatggtttcagccgcacaaactattcttccagactctgatggtgctatagatggacacctgagagaagtaggtttgactttccatttgttgaaggacgtccctggtcttatctccaaaaatattgttaaatcactagacgaggctttcaagcccttaggtatcagtgactggaactctctattttggattgctcacccaggtggtccagctatcttagatcaagtcgaaattaagttgggattgaaggaagagaagatgagagccaccagacatgtcttgtccgaatatggtaacatgtctagcgcatgtgtcctattcattttagatgaaatgagaagaaagtccgccaaagatggtgttgccaccactggcgagggtttggaatggggtgttttgtttggcttcggaccaggtttgactgtcgaaacggttgtacttcactctgtacctttgtaa

SEQ ID NO: 55 - DNA, 1344 bp, Artificial Sequence
  Synthetic
atgctaaatatacgtacaactatttgggatccaaacctgcctagaccacccttgccactttacaacaaacactccaccttgttgttcactaccatcacgtgtattagtcagtcacatttttctttattagtgatcgaaaagcaattgatggccagctcgatcgacattgctgcattcagagaggctcaaagggctcaaggaccagccactatcttggctattggtaccgctactccttctaactgcgtttatcaagcagactacccagattattactttagaataacaaagtctgaacacatggtagaattgaaagaaaagttcaagagaatgtgtgataagtccatgattaagaaaagatacatgcatctaaccgaagaatacttaaaggagaatccatctatttgtgaatatatggctccctcccttgacgctagacaagatgttgtcgtcgttgaagttccaagactaggtaaggaggccgccgtcaaggctatcaaagaatggggtaagccaaagagccaaataactcacttgattgtttgtaccacttctggtgtcgatatgcctggcgctgactaccagttgacaaaattgttgggtttacgtcctagcgttaaaagatttatgatgtaccaacaaggttgtttcgctggtggcaccgtcttaagaatggccaaggatttggccgaaaacaataaaggtgctagagttcttgttgtatgctcagaaatcactgctgtcacattccgtggtccaagtgacacacatttggactccatggtgggtcaagcattgtttggagatggtgctgctgccgttattgtgggttctgaccctgatttaacgaccgaacaaccattgttcgagatggtttctgctgcacaaactatccttccagacagtgaaggtgccattgacggtcacttaagggaagtcggtttgacttttcacctattgaaggatgtcccaggtttaatctctaagaacatagaaaaggctctgactcaggctttctccccattgggaatctcggattggaacagcattttctggatcgcacatccaggtggcccagctattttggatcaagttgaacaaaagctgaagttgaaagaggaaaagatgagagcaaccagacatgttctgtccgaatatggtaatatgtcaagtgcttgtgtcttgttcattttggatgaaatgcgtaagaagtctgttgaagacggtgctgctacgactggtgagggtcttgattggggtgttctatttggtttcggtcctggtctgaccgtcgaaaccgttgtattgcactcagttccaactaccagaccaattgtgccctaa

SEQ ID NO: 56 - DNA, 1170 bp, Artificial Sequence
  Synthetic
atggttactgtcgaggaagtacgtaaagctatgagagccgaaggacccgcaacagttttagctattggcaccgctacgcctgcccattgtgtcgaacaagctacctacccagattattactttagagttactaactctgaacacaaggctgagcttaaggaaaagttccagaggatgtgcgacaaatcccaaataaagaaaagatacatgtatttgactgaagaaatcctgaaggaaaatccaaacgtctgtgcctacatggctccatcgttggatgcaagacaagacatggtggtggttgaaattcctaagttaggtaaagaagctgccgttaaggctatcaaggaatggggtcaaccaaagtcaaagattacccacttggtcttctgtactacctctggtgttgatatgccaggtgctgactatcaattgactaagctattgggtctaagaccaagtgtaaagaggttgatgatgtaccaacagggttgctttgcaggaggtacagttctgagattagctaaagacttggctgaaaataacaaaggtgcccgtgtattggttgtctgttctgagatcactgctgttactttcagaggtccctccgatagccatttagactctttggtcggtcaagccttattcggtgatggcgctgctgccattatcgtgggtgctgatccaattccagaagtcgaaaagcctctttttgaggttgtttccgcagctcaaaccattttgccagactctgacggtgccatagatggtcacttgagagaagtcggtcttacattccatctattgaaagatgttccaggattgatcagtaagaacatcgaaaagtcccttgtcgaggctttccaacctttgggtatttcggactggaatagtatcttttggatagctcacccaggcggtcctgctattttagatcaagttgaacagaaattggccttaaaaccagaaaagttgagagctactagacacgttttgagcgaatatggtaacatgtcatctgcctgtgtgttgttcatcatggatgaaatgcgtaagaagtctgctgaggacggctttaagaccacgggtgaaggtcttgattggggtgtcttgttcggttttggtccaggactaactgtagaaaccgttgtcttgcattctttatgtacgtaa

SEQ ID NO: 57 - DNA, 1197 bp, Artificial Sequence
  Synthetic
atggctacacccttatattcctcgagcctttctgttgatgagatgatgaagaaccaaagagccaaaggtcctgcaaccatcctagctattggcacggctgccccaccaaattgttactcacaggctgaatacccagacttttatttccgtgtcaccaagtccgatcacaagactgaattgaaagaaaagttcaaaagaatatgcagtaagactatgattaagaccaggtacttgcatatcactgaaaaaactttggaggaaaacccatctatgtgtgactactctgctccttcttttgatgctagacaagaaattttgagaatggaagtaccaaagctgggtaaggaagccgcagagaaagctattaaggaatggggtcactccaagtccgaaatcacccatttaatattctgtacaacttctggttacgacatgccatcggcagactatcaattgaccaagttactgggattgaaccactcagtgaaaaggcacatgatctacttgcaaggttgtttcgctggtggcactgtcttgagacttgctaaggatttagccgaaaataataagggtgctcgtgttttggttgtttgcgctgaaattacaaccattacttttagaggtccacatttggagagcttactacctcaagccttgttcggtgacggtgcttctagcgtcattgtcggtagcgatccagacccactaacagaaagaccattgtttcagatcgtttcttcggctcaacatattctacccgattcagaagatactatcagaggtaagctaggtgaatctggattgatgttcttcttgaagaaaaacattaccaccttgatcgcttctgatatcgaaaaacttttaaaggaagccttcgaaccaataggtatctccgattggaacagtttgttttggattactcacccaggcggtccagcaattctgaaccaaatagagttagttttgggtttaaaggaagagaaaatgtgggcatccagaaaagttttgagtcaatatggtaacatggcttctgcttgtgtattatttgtgttggacgaaatgagaaagaagtctatgaaggacggaatggccacgactggtgatggtcttgactggggtgtcgctttcggttttggacctggtctgaccgtcgaaacagttgttttgcgttccatccctgttacttcctttacataa

SEQ ID NO: 58 - DNA, 1212 bp, Artificial Sequence
  Synthetic
atgtccagtctttcaaatagcctgcccttgatggaagacgttcagggaatcaggaaagcacaaaaggctgatggcaccgccacagtcatggctataggtacggctcatccaccacacattttcccacaagatacctacgctgacgtgtattttagagccactaactctgagcacaaggtagaattgaaaaagaagttcgatcatatctgcaagaaaactatgattggtaagcgttactttaactatgacgaagaatttctaaagaagtaccctaatattacttcctacgacgaaccatctttaaacgatagacaagacatctgtgttcctggtgttccagctttgggtaccgaggctgccgtcaaggctatagaagaatggggtagaccaaaatctgaaattactcacttggttttctgtacctcttgtggtgtcgacatgccttcggcagatttccaatgcgccaagttattgggtctacatgcaaacgttaataaatattgtatctacatgcaaggctgttacgctggtggtactgttatgagatatgctaaagatttggctgaaaacaaccgtggtgctagagtcttagttgtgtgtgccgaacttacaattatgatgttgagagctccaaatgaaacccacttggacaatgccatcggtatctcactgtttggtgatggagctgccgcattaattattggttccgatccaatcataggtgttgagaagccaatgttcgaaattgtttgcactaagcaaacagtcataccaaacactgaggacgtcattcacttgcatctaagagaaactggtatgatgttctacttgtctaagggttcgccaatgaccatctcgaataacgttgaagcttgtctaatcgacgtattcaagtccgtgggtattacaccccctgaagattggaactctttgttttggatcccacatccaggcggaagagctattttagaccaagttgaagcaaaattgaagttgaggccagaaaagttcagagctgctagaactgtcttatgggattacggtaatatggtttcagcctctgttggttatatactggatgaaatgagaagaaagtccgctgctaaaggtttggagacttacggtgaaggtttggagtggggagtcttgttgggttttggtcctggcatcacagttgaaaccattttgctacactctttacctttgatgtaa

SEQ ID NO: 59 - DNA, 1203 bp, Artificial Sequence
  Synthetic
atgaataacatcatacagatggagaagagagttgaaaagaacggtgaaggcaaatccgtggctacgattctagccatcggtacagctaatccacctaacttcattttacaatgcgattacccagacttttatttcaaagacgtcaacattaattctgatgacgatttgcaacgtcttaagttgaagtttaagagaatctgtgataacactaaaatcgaaaagaggcatgtagttgtcactgaagaatttttgaaacaaaataccgagaacggtaactacgaaagtctgtcgttggaaaagagattaaagttgcccaccgaagaagttgtcaagcttgcaaaggaagcttctttgaaagccattaaggaatggggtcaaccaatatcagagattactcacttaattttctatacaaccagctgtttcggatccgttccaggtcctgattctcgtttggctaagctattaaatttgaaaccaactgttaacagactgatgatgttcgtccacggttgtcatgctggtggaaccatcttgagagttgccaaagacatcgctgaaaacaacgtcggttctagggtcctggcagtgtgttctgagactatgttggcttcctttcaaaccccaacttccgacttcaataccgacattttgataggtcacgccttgtttggcgatggtgctgctgcaatgatcattggttctgatccaaacttaagtattgaaaagcctgttttcgaaatagtttcagctagtcaaacaacggttccagatactgaaaatatgatcagaggccaaccaggtcagatgggtagattggtctaccatttagacaagaacctacccaatatcgtagctaacaatgttgaaaagtgtttgatcgactttttcaacgaagactttgattggaataagcttttctacgctattcaccccggtggtccattggtcttgagcaaggtggaagaaaaactaggtttgaacgatgaaaaattaaaggaatcttggggcgttttaaatgaatatggtaacatgtggtccccaactgtgatttttatcttggatgagatgagaaaaagatcaaagaacgagggtaagggtacgaccggtgaaggactagaatggggtgttttgttgggtttcggaccaggtgttgccatagaaacagtactattacattctgtctcctgcgttaatcaataa

SEQ ID NO: 60 - DNA, 1200 bp, Artificial Sequence
  Synthetic
atggcaacaaaatccgtcgctgttgaggaaatgtgtaaggcccaaaaggctggaggccctgctactatcctggccattggtacggctgtaccatcgaattgctactatcagtcagaataccccgacttttacttcagagttactaagagcgatcatttaaccgatctaaaaagtaagttcaagcgtatgtgtgacaggtcctctataaagaaaagatatatgcacttgaccgaagaaatcttgaaagaaaacccaaacatgtgttcctttgctgcaccatctattgatggtagacaagacattgtcgttaaggagatcccaaagttagccaaagaagctgcttctaaggctatcaaggaatggggtcaacctgaatctaatattactcaccttgtgttctgtaccactagcggtgttgatatgccaggttgtgactaccaattgaccagattgttgggtcttagaccatccataaagagactaatgatgtatcaacagggttgccatgcaggaggcacaggtttgaggttagctaaggacttggccgaaaacaataaaggtgctcgtgtcttggtcgtttgttctgaaatgaccgtgataaactttagaggtccatcagaagctcacatggattctctggttggtcaatccttattcggtgacggtgcttccgccgtcattgttggttcggatccagacttgagtactgagcatcccctttaccaaattatgtctgcctctcaaatcatcgtcgctgattcggaaggcgttattgatggtcacttaagacaagagggtttgactttccacttgagaaaagacgttccttcattggtcagtgataacattgaaaatactctagtggaagcctttacccccatcttgatggatagcattgacagtattattgactggaactctatcttctggatcgctcacccaggtggtccagctatactaaaccaagtacaagctaaggtcggattgaaggaagaaaagttgagagtttctcgtcatatcctttctgaatacggtaacatgtcctccgcctgcgttttctttattatggatgaaatgagaaaaagatctgttgaggagggaaagggtacaacgggtgagggtttggaatggggtgtcttattcggtttcggtccaggttttaccgtcgaaactatcgttttgcattccgtaccaatctaa

SEQ ID NO: 61 - DNA, 1158 bp, Artificial Sequence
  Synthetic
atgaatcacttgagagccgaaggaccagcttctgttttagctattggtactgcaaaccctgagaacatactacttcaggacgaatttccagattattacttccgtgtcacgaagagcgaacatatgacacaactgaaagaaaagttcaggaagatctgcgataaatccatgatcagaaagagaaattgttttttgaacgaggaacacttgaaacaaaaccccagattggtggaacatgaaatgcaaaccttagacgctagacaagacatgttggtagttgaagtcccaaagttgggtaaggatgcttgtgccaaggctattaaggaatggggccaaccaaaatcaaagattacccacttaatcttcacttctgcttcgactaccgatatgcctggtgccgactaccactgtgctaaactattgggtctatctccaagtgttaagagagtcatgatgtatcagttgggttgctacggtggtggtaccgtacttagaattgcaaaagatatcgctgaaaacaataagggtgcacgtgttttggctgtttgttgtgacattatggcctgtctgtttagaggaccatccgaatctgatctggagttgttggtcggtcaagctatcttcggtgatggtgctgccgctgtcattgttggtgccgaaccagacgaatccgttggtgaacgtccaatttttgaattggtgtccactggccaaacaatcttaccaaattctgaaggaactatcggtggccatataagagaggctggtttaatcttcgacttgcacaaggatgttcctatgctaattagcaataacatagaaaagtgtcttattgaagcattcactccaattggtataagtgactggaactccattttctggattacccacccaggtggtaaggctatcttggacaaagtcgaagaaaagttacatttgaaatcagataagtttgttgattctaggcacgttttatctgagcatggtaatatgtcatctagtactgttttgtttgtaatggacgagttgagaaagagaagcttggaagaaggtaagtctactacaggtgacggtttcgaatggggtgtcttgtttggtttcggacctggactaaccgttgagagagtggtcgtaagatccgttcccatcaagtactaa

SEQ ID NO: 62 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 63 - protein, 598 aa, Yarrowia lipolytica
MSIIHKSPVPDVQLFYGSWPDLMRTSPHAHNDSKPVVFDFDTKQQLTWKQVWQLSARLRAQLYHKYGIGKPGALAPFHNDPSLGDVVIFYTPNTYSSLPYHLALHDLGATISPASTSYDVKDICHQIVTTDAVVVVAAAEKSEIAREAVQLSGRDVRVVVMEDLINNAPTVAQNDIDSAPHVSLSRDQARAKIAYLGMSSGTSGGLPKAVRLTHFNVTSNCLQVSAAAPNLAQNVVASAVIPTTHIYGLTMFLSVLPYNGSVVIHHKQFNLRDLLEAQKTYKVSLWILVPPVIVQLAKNPMVDEYLDSIRAHVRCIVSGAAPLGGNVVDQVSVRLTGNKEGILPNGDKLVIHQAYGLTESSPIVGMLDPLSDHIDVMTVGCLMPNTEARIVDEEGNDQPAVHVTDTRGIGAAVKRGEKIPSGELWIRGPQIMDGYHKNPESSRESLEPSTETYGLQHFQDRWLRTGDVAVIDTFGRVMVVDRTKELIKSMSRQVAPAELEALLLNHPSVNDVAVVGVHNDDNGTESARAFVVLQPGDACDPTTIKHWMDQQVPSYKRLYGGIVVIDTVPKNASGKILRRLLRQRRDDRVWGLAKVAKL

SEQ ID NO: 64 - protein, 598 aa, Yarrowia lipolytica
MVQIIHKAPLGDMAESELFYGSIPDFMRSSRFADDDTRISVVDYDTDKAMTLARVFKVSGMLRAQFFHTYDVGKKKDGDANPKVIFYVGNTADNLACHIALHDLGAIISPASTAYDVNDLLHQINVVDAALIVAEAARADVAREAVAKAGDKFKHVKVVVFEELLEQNRRVRPNLIRVAPIVHLSKEQAYTTLAYLGMSSGTSGGVPKAVELTHFAMTSNVQQTAKNAPNLVDDDTVCSAVIPTSHIYGLALFMLHMPFLGAKVVYHKKFDLVEMLEGQKKHGVNYWVLVPPIIVALAKHPIIDRYLDSIRANLKTITSGAAPLGGNVVDAVQTRFTGNTRGTLPNNRRIVIYQGYGLTETAPIACLCDPLWDNLNVVTVGTLVPNTEARIVDENGDDQPAFEVTDARALGDAVRRGDKIPSGELYLRGPQIMSGYHKNPKSTEESFEYVDYKAEGLRHYQDRWLKTGDVAVIDNFGRIQIVDRTKELIKSMSKQVAPAELEALLLSHPDVVDVAVIGVWQEEKATESARAFLVVRDPKVDVVAIKKWMDEQVPSYKRLYGGVVVIDAIPKNPSGKILRRLLRQRKDDVVQGLDQAKL

SEQ ID NO: 65 - protein, 597 aa, Yarrowia lipolytica
MTQIIHNATIPNIPVDQLYDGKITDFIRSGGHSNETKPSVIDAKTGQTLSQAEMWQLSDKYAALLSSQYGLCRHRDNELDPSMGDVLITFFGNVILAPVVHWAALDLGATISPGSTGYSAQDLAHQFRVTTPKVVVYAKAFKDVVDEATKLYNSPNPPALVELEALDKQARMVGNHKVEHTRKIKLAPHESRTRIAYLGMSSGTSGGVSKAVRLTHSNLTSCSEISNKASESLATDQQIAAAIIPVSHLFGLSKFLIGNPHAGATTVYHNGFDLIEVLEAQKKYKVNSWTLVPPIIVLLTKHPIVEKYIPSLRAHMRAILSGAAPLGANVTEALLTRVTGNKFGESPEGGLRIVQGYGLTETSPVATLFDPEDKERHIRSCGKLVPNSQVRIVNEDGVDQPAYDVDPNELDEAIKQGTLPVGELWIRGPQVMDGYHNNPEANEACFVKADDAEADTAYYNRHWFRTGDVALVDKQGRYMIVDRTKEMIKSQGKQVAPAELEDMLLGHAQVADTAVIGIQDVEKGNEAPRAFVVLKDPKYDAVEIKTWLDKQLPKYKQLHAGIVVIDAIPKNASGKILRRLLRARKDDVVLGLNKAKL

SEQ ID NO: 66 - protein, 530 aa, Rhodopseudomonas palustris
MGSSHHHHHHSSGTHPSIHAKSNPDKVAYRMASTGQALTYRQLDERSNQGAHLFRSLGLKAGDHIALLMENRLAFMEICWAAQRAGLYYTAISRYLTKDEIGYIVQDCGAKVVITSAQGSETMKSLLSDGPGAPLYYMVDPPTAGFRSWEQETAAQPTTPIADEVAGYDMLYSSGTTGRPKGIKREFEGNAIDVPSPFLRLLCEKMCGMNAESIYLSPAPLYHAAPLRFNMMATTLGGTSIIMEHFDAEQFLALVEKYKVTQSQLVPTMFVRMLKLPDEVRSRYDVSTLKGAIHAAAPCPVDVKAKMIEWWGPILIEYYAGSEGNGVTVSTSQQWLAHRGTVGKAVVGTIKILDDEGEEQPVGEIGTVYFADAPSFSYHNDPDKTKKAYNEKGWSTLGDVGYLDDEGFLYLTDRKSYMIISGGVNIYPQETEDVLLTHPDVADVAVFGVPNPEMGEEVKAVVQLRDGAAPSSERAAELIAFCRERLSPIKCPRSVDFEAELPRTPTGKLVKRHLKDRYWPSQQKAAAATA

SEQ ID NO: 67 - protein, 530 aa, Rhodopseudomonas palustris
MGSSHHHHHHSSGNITHGLRRALQINPEELATVCAGRRRNWREVGDRVARLAAGLRASGVGEGERVAILSLNSDRYLEMYLAAGWCGGVIVPLNIRWSALENEDALKDCRAVALVVDKAFAATGGALAQAMPSMALIYADDGDVPPGMQSYEDLIATHAPIPDAMRKAEDLAGIFYTGGTTGRSKGVMLSHGNLMANALNALGEGLFPGTSVYLHAAPMFHLANGAAMYSLLLSGGSNVMIPSFTPEGVMQAMQNDRVTDVLLVPTMIQMFVDHPALKNYDLSSLKNIVYGASPISEAVLARASAALPNVQFTQAYGMTELSPIATLLHWKEHIGEGKAKGRQRAAGRATLGCEVRIVDADDRTVPYGTVGEICVRGDNVMMGYWERPEETARALAGGWMHTGDGGYMDEHGFVYVVDRVKDMIISGGENVYSVEVENAVAQHPAVAQCAVIGIPHEAWGEQVHAVVVTKAGATVTAEELIAHCKALIAGYKCPRSVEITETPLPLSGAGKILKRELRQPYWESRERRVS

SEQ ID NO: 68 - protein, 598 aa, Yarrowia lipolytica; identical to SEQ ID NO: 64

SEQ ID NO: 69 - protein, 598 aa, Yarrowia lipolytica; identical to SEQ ID NO: 64

SEQ ID NO: 70 - DNA, 1797 bp, Artificial Sequence
  Synthetic
atgtcgattattcacaaaagcccagtccctgatgtccaactcttttacggatcttggccggatcttatgcgtaccagcccgcatgcgcacaatgactccaaaccggttgtctttgattttgataccaaacagcaattaacctggaaacaagtgtggcagcttagcgcgcgccttcgcgctcagctgtatcataaatatggtatcggaaagccgggtgcgctggcaccctttcataatgatccttcgttaggtgatgtagtgatcttttataccccaaatacgtatagctccctgccgtaccatctcgcactccatgatctgggtgcgaccattagtccggcaagcacctcgtatgatgttaaggatatttgccatcagattgtgactacagacgcggttgtggttgtggcggcagcagaaaaatctgagattgcacgcgaagccgtgcagttgagcggccgtgacgtccgtgttgtggttatggaggatctgattaacaatgcgcctacggtggcgcagaacgatatagattcagcgccacacgtttcgctttcgcgtgaccaggcccgcgcaaaaattgcgtatctcggcatgagcagcggcacctctggcggtcttccgaaggcggtgcgcctgactcatttcaatgtgaccagcaattgtctgcaagtatccgccgccgcccccaaccttgcacaaaacgtggtggccagcgcagttattccgacaacgcacatttacggcctgacgatgtttctgtcagttctgccgtacaatggctctgtggtgattcatcacaagcaatttaacctgcgtgatttgctggaagcgcagaaaacctataaggtttcgctgtggattctggtgccgccggtcattgttcagctcgccaaaaatccgatggtcgatgaatatctggacagtatccgtgcacacgttcgttgtatagtgagtggcgcggcaccgttagggggcaacgttgttgatcaggtgagcgtccgcctgacgggcaacaaggaaggcattctgccgaacggcgacaaactggttatccatcaggcctatggcttaacggaaagttcgccgattgtgggtatgcttgatcctttgagcgatcatattgacgtgatgacggtgggctgcctgatgccaaacaccgaggcccgcattgtcgatgaagaaggcaatgaccagccggctgtacacgtcacagatacacgcggcattggtgcggcggtcaaacgcggtgaaaagattccgagcggagaactgtggattcgcggaccgcagattatggatggctaccataagaaccccgaatcgagccgcgaatcactggagccgtccacggagacatatggactccaacactttcaggatcgctggcttcgcacgggcgatgtcgcggttatcgatacctttggacgcgtaatggttgtcgatcgtaccaaagagctcattaaaagcatgtcgcgtcaggttgcacccgcggagctggaggcgctgctgttaaaccatccttctgtgaacgatgttgcggtggtgggagtccataacgatgacaatggcaccgaatctgcacgcgcctttgtagtgctacagccaggtgacgcgtgcgacccgactactatcaaacactggatggaccagcaagtgccctcttataaacgcttatacggtggcattgttgtcattgataccgtgccgaagaatgccagcggtaaaatcctacgtcgtctgttacgccagcgtcgcgacgatcgtgtttgggggttagcaaaagttgcgaaactctaa

SEQ ID NO: 71 - DNA, 1797 bp, Artificial Sequence
  Synthetic
atggtacagattattcataaggctccgttaggcgatatggccgagtccgaacttttctatggatcgattcccgattttatgcgctcgagccgcttcgcagacgatgatacccgtattagcgtggtggattacgataccgacaaggctatgacattagctcgcgtttttaaggtcagtggcatgctgcgtgctcaattcttccacacatacgatgtcggcaaaaaaaaggacggtgatgcaaacccaaaagtaatcttttacgttggcaacacggccgataacctggcctgtcacattgcgctccatgacttaggcgccattattagcccggcgtccaccgcctatgacgtaaacgatttattgcaccagattaacgtggtagatgcagccctgattgtagcggaggcggcgcgtgcagatgtcgcccgcgaggcagtagcgaaggcgggagataagtttaagcatgtgaaagtggttgtttttgaagaactcctggaacagaaccgccgcgttcgcccgaatctcattcgtgtcgccccgatcgttcatctcagcaaagagcaagcctacaccaccttagcatacctgggaatgagctcaggtacgagtggcggggtgccgaaagccgttgaattaacccatttcgccatgacctcaaatgtccagcaaacggcgaaaaatgctccaaatctggtagatgacgacactgtttgcagcgcagtgattccaacttcgcacatttatggtctggcgctgtttatgcttcatatgccgtttttaggggccaaagttgtttaccataaaaaattcgatctggtagaaatgttagagggccagaaaaaacatggcgtcaattactgggtgttggtgccgcccattattgttgccttagcaaaacaccccatcattgatcgctatcttgactcgattcgtgcgaatctcaagacaattaccagcggggcggcgccattgggcggtaacgtagtagacgcagtccagacacgctttaccgggaatacccgcggtacattgcctaataaccgccgcattgttatttatcaagggtacggcttaacagaaaccgcccccattgcttgtttgtgtgatccgctgtgggacaacttaaacgtagtgaccgtgggcacgctggtcccgaacacggaggctcgcatcgtggatgaaaatggcgatgatcaaccagcattcgaggtgaccgatgcccgtgcgctgggtgatgctgtgcgccgcggagataagatccccagcggcgaactgtaccttcgcggcccgcagatcatgtccggctaccacaaaaacccgaaaagcaccgaggagtcctttgaatacgtcgattacaaggccgagggcttacgtcactaccaggaccgttggttaaagaccggagatgttgcagtaattgacaactttggacgtattcagatcgtggaccgtacgaaagagctgatcaagagcatgagtaagcaggtcgcgccggcggaactggaggcccttcttctgtctcatccggatgtagtagatgtcgcggtcattggggtctggcaggaagaaaaagctaccgaatccgcccgtgcgttcttagtcgttcgtgacccgaaagtggatgttgtcgcgatcaaaaaatggatggatgaacaagtcccgtcctataagcgcctgtacggaggggtggtcgtaattgacgccattccgaagaatccgagtggcaagatactgcgccgcttactccgccagcgcaaagatgatgttgtacaaggccttgatcaagcaaagctctaa

SEQ ID NO: 72 - DNA, 1794 bp, Artificial Sequence
  Synthetic
atgacccagatcatccataacgcaacaatccctaatataccggtggatcaactgtacgacggcaagattaccgattttattcgcagtggcgggcatagcaatgaaaccaaaccgtcagtgattgacgcaaaaaccggtcaaaccctgagccaggcggaaatgtggcagctgagcgataaatacgccgcgctcctgtcatcacagtacgggttatgtcgtcaccgtgataacgagctggatccatccatgggcgatgtactgatcaccttctttggtaatgtcatccttgcaccggtagtccactgggctgccctggacctgggcgctacgatttcgccgggctcgaccggttattcagctcaagatctcgctcatcagtttcgtgttacgaccccgaaagttgtggtgtacgccaaggcctttaaggacgtggttgatgaagccaccaagctgtacaacagcccaaatccccctgcgctggtggaactggaagccttggataagcaagcccgcatggtcggcaaccacaaagttgagcacactcgcaaaattaaattggcccctcacgagtcgcgcactcgcattgcttacctgggcatgtcgagtggtacatcgggcggcgtttcaaaagctgttcgtctgacacacagtaacttaacatcctgttcagaaattagtaataaggcgtccgaaagcctagcgacggatcaacagatcgcggcggccattatcccggtgtcccatctgttcggcctttcaaagttcctgattggcaatcctcatgcgggcgcaaccaccgtgtatcataatggttttgacctcattgaagtcctcgaagcccagaaaaaatacaaagtgaactcatggaccttagtgccgccaattatcgtgttactaacaaagcatccgatcgttgaaaagtacatcccatcactacgtgctcatatgcgtgccatccttagcggcgcggcgccgcttggggccaatgttacagaagcgctgctgacgcgtgtcaccggcaacaaattcggggagtctccagagggcggattacgtattgtccagggctacggcctcaccgaaacctcacctgttgcaacgttatttgatccggaggacaaagagcgccacatccgtagctgcggcaagttagtgcctaatagccaagtccgtattgtgaatgaagatggtgtagaccagccggcgtatgacgttgacccgaacgaactggacgaagccattaaacagggcacgctgccggtgggtgagctttggattcgcggcccgcaggttatggacggttaccataacaatcccgaagcgaacgaggcatgtttcgttaaagccgacgatgcagaagcagataccgcatactataaccgccactggtttcgcaccggagacgtggctctggtagataaacagggccgctatatgattgtagatcgtacaaaagaaatgatcaaatctcagggaaaacaggttgcgccggctgaactggaggacatgctgcttggccatgcgcaggttgcggataccgcggtgatcgggatccaggatgtcgaaaaaggaaatgaagcgccacgcgcattcgtggtgctgaaggacccaaaatacgacgcagttgaaatcaaaacctggctcgataaacagttacccaaatacaaacaacttcatgcggggattgtggtgatcgatgccatcccgaagaacgcctcgggtaaaattcttcgccgcctgctccgtgcgcgcaaggatgatgtggtgttagggctgaacaaggcaaagctctaa

SEQ ID NO: 73 - DNA, 1593 bp, Artificial Sequence
  Synthetic
atgggcagcagccatcatcatcatcatcacagcagcggcacacatcccagcatccatgcaaaatccaacccggataaggtagcctaccgcatggctagcactgggcaagcattaacctatcgtcagttggacgagcgcagtaatcaaggagcacatttatttcgttcattgggattgaaggcgggggaccatattgcgttgttgatggagaaccgtttagctttcatggaaatctgctgggccgcccaacgcgcaggcttatactacactgctatttctcgctatcttactaaagatgagatcgggtacatcgttcaggactgtggtgcaaaagtagtcatcacgtctgcgcaaggatcggagacaatgaagagcctgctttccgacgggccaggggcacctctgtattacatggtagatcctccaactgcgggtttccgttcctgggaacaagagactgctgctcaacccaccacgccgattgctgacgaagtggccggttatgacatgctttactcttcggggacgacggggcgcccgaaggggatcaaacgcgagtttgagggaaacgcaatcgacgtcccgtctccatttctgcgcttgttgtgtgaaaagatgtgcggaatgaacgcagaatccatttacttatcccccgcccctctgtaccatgctgccccgcttcgctttaacatgatggcaaccactctgggcggaactagcatcatcatggaacactttgacgcagaacaattccttgctcttgtagaaaaatataaggttacccagtcacagcttgttcctactatgttcgttcgcatgttaaagttgccggatgaagtacgctcacgctatgatgtatcaacattaaagggggctatccatgctgcagcgccttgccctgtagatgtaaaggccaaaatgattgaatggtggggcccgatcttaatcgaatattacgcggggagtgaaggcaatggtgtcaccgttagcacgagtcaacaatggcttgcccaccgtgggaccgtgggaaaagccgtcgtaggaacaattaagattttggatgatgaaggggaggagcagccagttggggaaatcggtacggtgtactttgccgatgcgccctccttctcttatcacaacgacccggataaaactaaaaaggcatacaatgaaaaggggtggtcgactctgggagatgtgggctaccttgatgacgaaggcttcttatacttgacggatcgtaaaagttatatgattatcagtgggggagttaacatctaccctcaagaaacagaagatgtccttcttacgcaccccgacgtggccgatgtagctgtcttcggcgtcccaaatccagaaatgggtgaagaagttaaagcggttgtacaactgcgtgacggcgccgcaccatcaagcgagcgtgctgcggagttgattgcattttgtcgtgaacgtttatccccgattaagtgtccccgttctgtggattttgaagcggaattgccgcgcacaccgactgggaaattagtgaagcgtcacttgaaggaccgctactggccaagtcaacagaaggctgccgccgctactgcatga

SEQ ID NO: 74 - DNA, 1593 bp, Artificial Sequence
  Synthetic
atgggcagcagccatcatcatcatcatcacagcagcggcaacatcactcatggactgcgtcgcgccttgcagattaaccccgaagagcttgcgacggtttgcgccgggcgtcgtcgtaactggcgtgaggtgggagatcgtgtggcacgcttggcggccggattgcgtgcttcgggtgtgggggagggagagcgtgtggcgattttgagccttaattccgatcgttatttagagatgtatttggctgctggatggtgtgggggagtcattgtaccactgaacattcgttggtcggcgttagagaatgaagacgcacttaaagattgtcgtgcagttgcactggtcgtagataaagcatttgccgccactggtggcgcgttggcacaagcgatgccctcaatggcccttatctatgctgatgacggtgacgtaccaccaggcatgcaatcatacgaggacctgattgccacccatgcacctattccagacgcaatgcgtaaggcggaggacttagctggtattttttatacgggaggaactaccggacgttcaaaaggggtgatgttatcccacggtaatttgatggcgaatgccttaaacgctcttggcgaagggcttttccctgggacaagcgtttaccttcatgctgctccgatgttccatttagctaatggggctgcgatgtacagcttactgttatcaggaggttcaaatgttatgattccctcatttacacctgagggagttatgcaggcaatgcaaaatgatcgcgttacggacgtcctgttggtaccaaccatgattcagatgtttgttgaccaccctgcccttaaaaactatgatttgtcgtctcttaagaatatcgtatatggtgcgtcaccaatctcggaagcagtccttgcccgtgccagtgcagctcttcctaacgtgcagttcacccaagcttatgggatgacagaactgtcacctattgcaacgcttctgcattggaaagaacacattggggagggcaaggcgaagggacgtcagcgtgctgctgggcgcgcaactttaggatgtgaggtccgtattgttgatgccgacgaccgcaccgtgccgtacgggacagttggggaaatttgtgttcgtggcgacaacgtaatgatgggttattgggaacgtcctgaggaaaccgctcgcgctctggctggtggttggatgcataccggtgatggagggtatatggatgaacacggatttgtttatgttgttgaccgcgtaaaagatatgatcattagcgggggagagaatgtgtactccgttgaggtggaaaatgcagtggcgcaacatcctgcggttgcacagtgtgcagttattggtatccctcacgaagcctggggagaacaagtacatgctgtggtagtaactaaggccggtgccaccgtcactgcggaggagttgattgcacactgcaaagctttaattgctggctataagtgtccgcgttcagtagagatcacagagacaccacttcctcttagcggtgcggggaagattttgaagcgcgaactgcgtcagccgtactgggagtcacgtgagcgtcgcgtgtcatga

SEQ ID NO: 75 - DNA, 1788 bp, Artificial Sequence
  Synthetic
atggttcaaattatccacaaggccccattaggtgatatggctgaatctgagctattttatggatccatacctgacttcatgcgttcatctaggttcgctgatgacgatactagaatctcggtagtcgactacgatacagacaaagcaatgaccttggctagagtgtttaaggtcagcggtatgctgagagcccagttcttccatacgtacgatgttggcaagaaaaaggacggtgatgctaaccccaaggttattttttatgtcggtaataccgctgacaacttggcttgtcacatcgcacttcatgatttgggtgccattatttctccagctagtactgcttacgacgttaatgacttattgcaccaaattaacgttgtggatgcagcccttatcgttgccgaagctgctagagctgacgttgctagagaagccgtcgctaaggcaggagataaatttaaacacgttaaggtagtcgtcttcgaagaattgctagagcaaaaccgtagagttagaccaaatttgattagagttgctccaatcgtacatttatccaaggaacaagcttacactaccttggcttatttaggtatgtcatctggtactagcggtggtgttcctaaagccgtcgaattgacccatttcgctatgacatccaacgttcaacagactgctaagaacgctccaaatttggtggacgatgatacagtctgctccgctgtaattccaacttctcacatatacggtcttgctttgttcatgctacacatgccatttttgggtgccaaggttgtgtaccataagaagttcgatctagtcgaaatgttagagggtcaaaagaaacacggcgttaactattgggtgttggttccaccaatcatcgtcgccctggctaagcatcctattattgaccgttacttggattctataagagcaaatttaaaaaccatcacttctggtgccgccccattgggtggtaacgttgtcgacgctgttcaaacaaggtttacgggaaacaccagaggtactttacccaataatagaagaattgttatctatcaaggttacggcttgacggaaaccgcaccaatcgcttgtttgtgtgatcctttgtgggacaacttgaatgtagtcactgttggtactttggttccaaacaccgaagctagaattgtagacgaaaacggcgatgaccaacccgcctttgaagtcactgacgccagggctctgggtgatgctgtcagaagaggagataagattccatcgggtgaactatatttgagaggtccacaaatcatgtctggttaccataagaaccctaaatccactgaagaatccttcgagtacgttgactataaggccgaaggtttgcgtcactaccaggatagatggttaaaaaccggtgatgttgctgttatcgataacttcggtagaatacaaattgttgatagaactaaggaattaataaagtcaatgagtaagcaagtcgccccagctgaacttgaagctcttttattgagtcacccagatgtagtcgacgtcgctgttattggtgtttggcaagaagagaaagcaacagaatcggctagggctttcctggtggttagagatcctaaggtcgatgtggtagccatcaagaagtggatggacgaacaggttcctagctacaaaagattgtatggtggtgtggttgtcatcgacgctataccaaaaaatccatccggaaagattttaagaagattgcttcgtcaaagaaaagacgatgtagtccaaggtttggatcaataa

SEQ ID NO: 76 - DNA, 1788 bp, Artificial Sequence
  Synthetic
atggtgcagatcatacacaaggctccattgggagacatggcagaatccgagttattctatggcagcattcctgattttatgcgttcaagtagattcgccgacgatgacacgaggatttctgttgtagattacgacacagataaagctatgactctggctagagtctttaaggtttctggtatgctaagagcccaattcttccatacctacgatgtcggtaagaaaaaggacggtgacgctaatccaaaggttatcttttacgtcggtaacaccgctgataacttggcttgccacattgccttgcatgatcttggtgcaatcatatcccccgcctctactgcttatgacgtcaacgatttgttacaccaaattaatgttgttgacgctgctttgatcgtagccgaagctgctagagctgatgtggcaagagaagctgttgccaaagccggtgacaagtttaagcatgtcaaagttgtagttttcgaagaacttctggaacaaaacagacgtgttagaccaaatttaattcgtgttgctcctatcgttcacttgtccaaggagcaagcttacactaccttggcatatttgggtatgtcttcgggtactagcggtggcgtcccaaaggctgtcgaactaactcatttcgctatgacctctaacgttcaacagacagctaagaatgctccaaacttagtagacgatgatacagtctgttctgccgtgattcctacttcacacatttacggtttggctttgtttatgctacacatgccattcttgggtgccaaggtagtctaccacaaaaagttcgatctggtcgaaatgttggaaggtcaaaagaaacatggtgttaactattgggttttagttccaccaatcatcgtcgctttggcaaagcacccaataattgacagatacttagactccataagagcaaatttgaaaaccattacttcaggtgccgccccacttggtggaaatgttgttgacgctgtccaaaccagatttactggcaacaccagaggaacgctgccaaacaatagaagaatcgtaatctaccaaggttacggtttgaccgaaactgctccaattgcttgtttgtgtgatcccttatgggacaacctaaacgttgtcacagttggtacattggtgccaaacaccgaagcccgtatcgtcgacgagaatggtgatgatcaacccgctttcgaagttactgatgctagagctttgggtgatgcagttaggagaggtgataagattccaagcggtgagttgtacttaagaggccctcaaatcatgtccggttatcacaagaatcctaagtctactgaagaatcttttgaatatgttgattataaagcagaaggtttgcgtcattaccaagacagatggttaaagactggtgacgtcgctgtgatcgacaacttcggcagaatacaaattgttgatagaactaaagaattgattaaatctatgagtaagcaagtagccccagcagaactagaagctttattgctatcccatccagacgtcgttgatgtcgctgttattggtgtttggcaggaagaaaaggctacggagagtgctagagcattcttggtcgtcagggatccaaaagtagacgttgttgctattaagaagtggatggatgaacaggttccatcgtacaaaagattatacggcggtgtggtcgtgattgacgccatcccaaagaatccctctggtaaaattttgagaagattgttgcgtcaacgtaaggacgatgttgttcaaggtttggatcaataa

SEQ ID NO: 77 - protein, 385 aa, Cannabis sativa; identical to SEQ ID NO: 5

SEQ ID NO: 78 - protein, 385 aa, Cannabis sativa; identical to SEQ ID NO: 5

SEQ ID NO: 79 - protein, 385 aa, Cannabis sativa; identical to SEQ ID NO: 5

SEQ ID NO: 80 - protein, 385 aa, Cannabis sativa
MNHLRAEGPASVLAIGTANPENILIQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSDSDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 81 - protein, 395 aa, Fourraea alpina
MVMGTPSSLGEIRKAQRADGPAGILAIGTANPANHVIQAEYPDYYFRITNSEHMTDLKEKFKRMCDKSMIRKRHMHLTEEYLKDNPDMCAYMAPSLDARQDIVVVEVPKLGKEAAVKAIREWGQPMSKITHLVFCTTSGVDMPGADYQLIKLLGLCPSVKRVMMYHQGCFAGGTVLRLAKDIAENNRGARVLIVCSEITVVTFRGPSETHLDSLVGQSLFGDGAAALIVGSDPDTSAGEKPIFEMVSAAQTILPDSEGAIEGHLREVGLTFHLLKTVPGLISKNIEKCLEEAFKPLGISEWNSLFWIAHPGGPAILDHVQIKLGLKAEKMRATRHVLSEYGNMSSACVFFILDEMKRKAAEDGAATTGEGLEWGVLFGFGPGLTVETVVLHSVPL

SEQ ID NO: 82 - protein, 398 aa, Punica granatum
MAATTTPTIEEIRKAQRASGPATVLAIGTATPSNCVSQADYPDYYFRITNSEHKTELKEKFKRMCEKSMIKKRYMHLTEEFLKENPNMCAYMATSLDARQDIVVVEVPKLGKEAASKAIKEWGQPKSKITHLIFCTTSGVDMPGADYQLTKLLGLRPSVKRFMMYQQGCFAGGTVLRLAKDLAENNKGARVLVVCSEITAVTFRGPSDTHLDSLVGQALFGDGAAAVIVGADPDTKIERPLYQLVSAAQTILPDSDGAIDGHLREVGLTFHLLKDVPGLISKNIEKSLVEAFTPIGINDWNSIFWIAHPGGPAILDQVEAKLGLKEEKMRATRHVLSEYGNMSSACVLFILDEMRKKSLKEGKATTGEGLDWGVLFGFGPGLTVETLVLHSVPIEPAH

SEQ ID NO: 83 - protein, 388 aa, Cardamine apennina
MVMGDVPSLDEIRKAQRADGPAGILAIGTANPANYVIQAEYPDYYFRITNSEHMTDLKEKFKRMCDKSTIRKRHMHVTEEFLKENPNMCAYMAPSLDARQDIVVVEVPKLGKEAAVKAIKEWGQPKSKITHLVFCTTSGVDMPGADYQLTKLLGLRPSVKRLMMYQQGCFAGGTVLRLAKDLAENNRGARVLVVCSEITAVTFRGPSETHLDSLVGQALFSDGAAALIVGSDPDTSVGEKPIFEMVSAAQTILPDSDGAIDGHLREVGLTFHLLKDVPGLISKNIEKSLDEAFKPLGISDWNSLFWIAHPGGPAILDQVEIKLGLKEEKMRATRHVMREYGNMSSACVLFILDEMRKKSAKDGVATTGEGLEWGVLFGFGPGLTVETV

SEQ ID NO: 84 - protein, 355 aa, Unknown
  Mycobacterium sp. YR782
MRPISVIAGVRGELPAHRYSQAEVTEAFLTIGGYGDYEEILRKLHRSAKVDNRHFVLPLDQYPALKDFGEANDLFIENAVELGSAAVAGALEEAGLRPEDVDLIVSTTVTGVAAPSIEARIAGRLGMRPDVRRVPMFGLGCVAGAAGVARLHDYLRGDPDGVAVLVSVELCSMTYTANKPTLPGLVGSALFADGAAAVVAVGERRAEKIKASGPDVIDSRSHLYPDSLRTMGWDVGADGLELVLSADLPEVIERYLPDDVTEFLGAHSLKLDDIGTWVCHPGGPKIIEAIVNSLNLPDEALELTWRSLADIGNISSSSVLHVLRDTIAKRPAAGPSVMMAMGPGFCSELVLLRWH

SEQ ID NO: 85 - protein, 390 aa, Unknown
  Kocuria sp. CNJ-770
MTPALLSLGTALPPHVLEQTDAQDLYQAQPGTDRLNARLLRTVFGASGVARRHTVLSELVDHDARKDSPYITGDGRFRAPLTGARNRTYMEEAPGLFAAAARDALARCPAVDPTSITDVVTVSCTGFFAPGPDYHLVRDLGLNPATRRSHIGFMGCHGGLIGLRQAAAIATADPDAVVLLVAVELCTLHLRPARDADAIRGAALFADGAAAALIGSRVPDGCAPLLQLDRFRTLVIPDGEQAMAWTIGDSGFEMILGAAVPQVLEDNIHAALEALLEGPEGAVDRASITDWALHPGGRGILDKLEHTLDLAPEALRESRDVLATRGNMSSVTVLHVLRQVIDEAPPGEDRTVCALAFGPGLTVESALFTIPARPAAPAAHAHSATAVPTP

SEQ ID NO: 86 - protein, 224 aa, Unknown
  Arthrobacter sp. Hiyo1
MGCYAAFPALRAARQFCQADPSAVVLVICVELCSLHVRTSNDPDTIMGSAIFADGAAAAVVTSREPEGPDPVIRLDHFETVLTPVGEEAMAWNIGDEGFEMVLGTYVPHIIEEHITGALEPLLARDPSLAGLPYRDITHWAIHPGGRSILDKVESKLELTEEQMIPARDVLRDYGNMSSATVLFVLKHILGQTPAEREERICSMAFGPGLTVETGLFTRVSPTL

SEQ ID NO: 87 - protein, 391 aa, Citrus sinensis
MATVQEIRNAQRADGPATVLAIGTATPAHSVNQADYPDYYFRITKSEHMTELKEKFKRMCDKSMIKKRYMYLTEEILKENPNMCAYMAPSLDARQDIVVVEVPKLGKEAATKAIKEWGQPKSKITHLIFCTTSGVDMPGADYQLTKLIGLRPSVKRFMMYQQGCFAGGTVLRLAKDLAENNKGARVLVVCSEITAVTFRGPADTHLDSLVGQALFGDGAAAVIVGADPDTSVERPLYQLVSTSQTILPDSDGAIDGHLREVGLTFHLLKDVPGLISKNIEKSLSEAFAPLGISDWNSIFWIAHPGGPAILDQVESKLGLKGEKLKATRQVLSEYGNMSSACVLFILDEMRKKSVEEAKATTGEGLDWGVLFGFGPGLTVETVVLHSVPIKA

SEQ ID NO: 88 - protein, 390 aa, Narcissus tazetta
MVTIDEIRKAQRADGPATILAIGTANPQNCIEQSTYPDYYFRVTNSEHMVELKQKFKRMCEKSMIKKRYMYLTEEILKQNPNLCAYMAPSLDARQDMVVVEVPRLGKEAAVKAIKEWGQPKSKITHLVFCTTSGVDMPGADYQLTKLLGLRPSVKRLMMYQQGCFAGGTVLRLAKDLAENNRGARVLVVCSEITAVTFRGPTDTHLDSLVGQALFGDGAAAMIIGADPVENVERPIFKLVSAAQTLCPDSEGAIDGHLREVGLTFHLLKDVPGIISKNIERCLDDAFKPLGISDWNSLFWIAHPGGPAILDQVEEKLKLKEEKMRATREVLSEYGNMSSACVVFILDEMRKRSAAQGKGTTGEGLEWGVLFGFGPGLTVETVVLHSVATS

SEQ ID NO: 89 - protein, 395 aa, Abies alba
MPAGMMADLEAFRKAQRSDGAATILAIGTATPPNSVDQSSYPDYYFKITNSEHMTELKEKFRRMCDKSAINKRYMYLTEEILKENPKVCEYMAPSLDARQDMVVVEVPRLGKDAAAKAIKEWGQPKSKITHVIFCTTSGVDMPGADYQLTKLLGLRPSVKRVMMYQQGCFAGGTVLRVAKDLAENNRGARVLVVCSEITAVTFRGPSDTHLDSMVGQALFGDGAAALIVGADPVPQVEKPCFEIIWTAQTILPDSDGAIDGHLREAGLTFHLLKDVPGLISKNIERSLVEAFQQFGISDWNQLFWIAHPGGPAILDQVEKKLNLDPKKLRATRQVLSEYGNMSSACVHFILDEMRKSSRENGCSTTGEGLDVGVLFGFGPGLTVETVVLKSVPLQ

SEQ ID NO: 90 - protein, 390 aa, Mimulus guttatus
MASIEDIRRAQRAEGPATILAIGTATPANCVKQSEYPDFYFRITDSEHMTELKEKFKRMCEKSQIKKRYMHLTEEILKENPNMCAYMAPSLDARQDIVVVEVPKLGKEAAEKAIQEWGQPKSKITHLVFCTTSGVDMPGCDYQLTKLLGLRPSVKRIMMYQLGCFAGGTVLRMAKDLAENNAGARVLVVCSEITAIMFRGPNGSPIDSLIGQFLFGDGAAAVIVGSDPVVGVERPLFQLVSAAQTLLPDSHGGIDCHLREAGLTFHLRKDVPALISKHIGESLKEAFDPLGISDWNSIFWIAHPGGPAILDQVESTLALKPEKLRSTRHVLSEYGNLSSACVLFILDEMRKSSAKEGMSTTGEGLNWGVLFGFGPGLTVETVVLHSVAIN

SEQ ID NO: 91 - protein, 350 aa, Streptomyces scopuliridis
MTRIAAVHGALAPHRYAQHDITDMVAKTCLPAGADRQVLDRLHRGARVDTRHTALPLEQYDGLKDFGAVNDAFIAGALPLGAEAVGGALDAAGFSPRDVDLLMFTSVTGIAAPSVDARLVGRLGLRSDVKRVPVFGLGCVAGAAGIARLHDYLLGRPDDVAVLLSVELCSLTFQRDDVSSANLVATALFGDGAAAVVACGPRRRPIGPVVVETRSHLYPDTEQAMGWDITGSGFRIVLDASVPELVRKNLAADVAGFLADNGLTREDITAWVCHPGGPKVLEAVEEVLELPADALDMTWRSLAAVGNLSSSSVLHVLRDTLAERPPPPGTYGLLLAMGPGFCSELVLLRW

SEQ ID NO: 92 - protein, 395 aa, Abies alba
MPAGMMADLEAFRKAQRADGPATILAIGTATPPNAVDQSTYPDYYFKVTNSEHMTELKEKFRRMCDKSAIKKRYMYLTDEILKENPNVCEYMAPSLDARQDMVVVEVPRLGKEAAAKAIKEWGQPKSKITHVIFCTTSGVDMPGADYQLTKLLGLRPSVKRVMMYQQGCFAGGTVLRVAKDLAENNRGARVLVVCSEITAVTFRGPSDTHLDSMVGQALFGDGAAALIVGADPIPEVEKPCFELLWTAQTILPDSDGAIDGHLREVGLTFHLLKDVPGLISKNIEKSLVEAFQQFGISDWNQLFWIAHPGGPAILDQVEVKLNLDPKKLRATRQVLGEYGNMSSACVHFILDEMRKSSREKGCSTTGEGLDVGVLFGFGPGLTVETVVLKSVPLQ

SEQ ID NO: 93 - DNA, 1158 bp, Artificial Sequence
  Synthetic
atgaaccacttacgtgcagagggtccagcctctgtgctagctataggaaccgctaatcctgaaaacattctgttgcaggatgaatttccagactattacttcagggttacgaagtccgaacatatgacacaacttaaagaaaagttcagaaaaatctgtgataagagcatgattagaaagagaaattgctttttgaacgaagaacacttgaagcaaaatcccagattggtcgagcatgaaatgcaaactttagacgctagacaagatatgctagtcgtagaagttccaaaattgggcaaggacgcctgtgctaaggcaatcaaggagtggggtcaaccaaagagtaaaatcacccacttgattttcacttcagcctcgactacagacatgcctggtgctgattaccactgtgcaaagttgttaggtttatccccatctgttaagagagttatgatgtaccaattaggttgttatggtggcggtactgtcttgcgtatagctaaggatattgctgaaaacaacaaaggtgccagagttttggctgtatgctgtgacatcatggcttgtttgttcagaggtccatctgaatctgatctggaattgctggtcggtcaggctatttttggagatggtgctgccgctgtcatcgttggtgctgaacctgacgaatcagttggtgaaagaccaatctttgaattggtgtccaccggtcaaaccattctaccaaactctgagggcacgattggtggtcatatacgtgaagccggcctaatcttcgatttacacaaagacgttccaatgcttatctcaaataacattgaaaaatgcctaattgaagccttcactcctattggtatatccgactggaatagtatcttctggatcactcatccaggaggaaaggctattttggacaaggtggaggaaaagttacatttgaagtctgataagtttgtcgacagtagacacgtactttctgagcatggtaacatgtcctcttccactgttttgtttgtcatggatgaattgagaaaaagatctttagaagaaggtaagtcgaccacaggtgatggtttcgaatggggcgttctttttggtttcggtcccggtctaacagttgagagggttgttgtcagatccgtcccaattaagtactaa

SEQ ID NO: 94 - DNA, 1158 bp, Artificial Sequence; identical to SEQ ID NO: 61
  Synthetic

SEQ ID NO: 95 - DNA, 1158 bp, Artificial Sequence; identical to SEQ ID NO: 62
  Synthetic

SEQ ID NO: 96 - DNA, 1158 bp, Artificial Sequence
  Synthetic
atgaatcatctgcgtgctgagggcccagccagcgtccttgctatcggaaccgcaaaccccgaaaacatactaattcaggacgaatttcctgattactatttcagggtaactaaatcagaacacatgacgcaattgaaggaaaagttcagaaaaatctgtgataagtccatgattagaaagagaaattgctttttaaacgaggaacacttgaagcaaaatccaagattagttgaacatgaaatgcaaacattggacgctagacaagatatgttggtggtcgaagttccaaaattgggtaaggacgcctgtgctaaggctattaaggagtggggtcaaccaaagtcgaaaatcactcacctgattttcacctccgctagtactaccgatatgccaggtgccgattaccactgtgcaaagttattgggtttgtctccttctgttaagagagtcatgatgtaccaactaggttgttatggtggtggtactgttttgagaatcgctaaagacattgctgaaaacaacaagggagctagagtgttagccgtttgctgtgatataatggcttgtttgttccgtggaccatctgactctgacctagaattgctggttggtcaagccatttttggtgacggtgctgctgctgttatagttggcgccgaaccagacgaatccgtcggtgaaagaccaatcttcgaattggtcagtacaggtcagaccatccttcctaactctgaaggtactattggtggtcatattagagaagctggtttaatctttgatttgcacaaagatgtaccaatgctaatctctaataacattgagaaatgcttgattgaggcattcactcccataggaatctcagattggaactcaattttctggatcacgcatccaggtggtaaggccattttggataaggttgaagaaaaattacatttgaagtccgacaagttcgtcgacagccgtcacgtcctaagtgaacacggtaatatgtcgtcttctaccgttttgtttgtgatggacgaattaagaaagcgttccttggaagaaggtaagtctactaccggtgatggttttgagtggggcgttttgtttggtttcggccctggtttgacagttgaaagagtggtcgtcagatccgttccaatcaaatactaa

SEQ ID NO: 97 - DNA, 1188 bp, Artificial Sequence
  Synthetic
atggtaatgggaaccccatcttccttgggtgaaatacgtaaagctcagagagccgacggtcctgctggtattctagcaatcggtacggctaacccagccaatcacgtgattcaagctgagtaccccgattattacttcagaatcacaaacagtgaacatatgactgacctgaaggaaaagtttaaaagaatgtgcgataagtcgatgattaggaagagacacatgcatttaactgaagagtacttgaaggacaatccagatatgtgtgcttatatggcaccaagcttggatgctagacaagatatcgtcgttgttgaagttccaaaacttggcaaggaagccgctgtcaaagctattcgtgaatggggtcaacctatgtctaagatcactcacttagttttctgtaccacctccggtgtcgacatgccaggtgccgactaccaactaattaagttgctaggattgtgtccatcagttaagagagttatgatgtaccaccaaggttgttttgctggcggtactgtcttaagattggcaaaggatatagcagaaaacaatagaggtgctagggtattaatcgtctgctctgaaattaccgttgttactttccgtggtccctcagaaacacatttggattctttggtcggtcagtccttgttcggtgacggtgctgctgccttgatcgtgggttctgacccagatacgtctgctggcgaaaaacctatatttgagatggttagtgctgcccaaactattcttccagattccgaaggtgctatcgagggacacctgagagaagtcggtctgacatttcatttgttaaagaccgttcctggtttgattagtaagaacatcgaaaagtgtttggaagaggccttcaaaccattaggtatttctgaatggaacagccttttctggattgctcatccaggtggtccagctatcttagaccacgtacaaatcaagttgggtctgaaagccgaaaagatgagagcaactagacacgttttatcagaatatggcaacatgtcctctgcttgtgttttctttattttggatgaaatgaagagaaaggctgccgaggatggtgctgctaccactggtgaaggattggaatggggagttctattcggttttggtccaggtttgacagtggaaaccgtcgtcttgcatagtgttccattgtaa

SEQ ID NO: 98 - DNA, 1197 bp, Artificial Sequence
  Synthetic
atggctgcaactacaaccccaactatcgaagagataagaaaagctcaaagggcctcaggtcctgccaccgtcttggctattggcacggctactccaagcaattgtgtatcgcaggccgattatccagactactactttagaatcactaactccgaacataagaccgaactgaaggaaaagttcaaaagaatgtgcgagaagtctatgattaagaaacgttatatgcacctaaccgaagaatttttaaaggaaaaccccaatatgtgtgcttacatggctacatccttggacgcaagacaagatatcgttgtggttgaagtcccaaaattgggaaaggaagctgccagtaaggcaattaaggaatggggtcaacctaaatcaaagattactcacttaatattctgtacgacttctggtgttgatatgccaggtgccgactaccaacttaccaagttgttgggtcttagaccatctgtcaaacgtttcatgatgtatcaacaaggttgttttgctggtggtacagttttgagattagctaaagatttggctgaaaacaacaagggtgctagagttttagtagtctgttctgaaatcactgctgttactttcagaggcccttccgacacccatttggactctttggtcggtcaggcattgttcggtgatggtgccgccgctgttatcgttggagctgacccagatactaagattgagaggcccttataccaactggtcagcgctgctcaaaccatcctaccagactcagatggtgctattgatggtcacctaagagaagttggtttgacctttcatttgcttaaggacgtcccaggattgatatctaagaacattgagaaatctctggttgaagctttcactccaatcggtattaatgattggaacagcattttttggatcgctcaccctggtggtccagccatcttggatcaagtggaagctaagctgggcttgaaggaagagaagatgagagcaactagacatgtcttatccgaatatggtaacatgtcctcggcctgcgttttgttcattttggatgagatgagaaagaagtctctaaaggaaggtaaagccacaactggtgaaggtttagattggggagtgttgttcggtttcggtccaggccttacggtcgaaaccctggttttacactcagtgccaatagaacccgctcactaa

SEQ ID NO: 99 - DNA, 1167 bp, Artificial Sequence
  Synthetic
atggtgatgggtgatgttccatctttagacgagataaggaaagcacagagagctgatggacccgccggcatcctagctattggtaccgctaaccctgccaattatgtcatccaagcagaatacccagactactacttccgtattacaaactccgaacatatgactgatttgaaggaaaagtttaaaagaatgtgcgacaagtcgactattagaaagagacacatgcacgtcacggaagaatttttgaaggaaaatccaaacatgtgtgcttatatggctccatcacttgacgctagacaagatatagtagttgttgaagttcctaagttgggtaaagaggccgctgtcaaggctatcaaagaatggggtcaaccaaagtctaagatcactcatctggttttctgtaccactagcggtgttgatatgccaggcgcagattaccaattgaccaagctattaggtttgcgtccaagtgtcaaaagattgatgatgtatcaacaaggttgtttcgctggtggtaccgtcttaagattggccaaggacttagccgaaaataacagaggtgctagagtacttgtcgtttgttctgagattactgctgttactttccgtggtccttctgaaacacacttggactcattggtgggtcaggctcttttttcggacggagctgctgcattgattgtcggttccgatccagatacctccgttggtgaaaaaccaatttttgaaatggtaagtgctgcccaaacaatcttgccagactccgatggtgccattgatggacatctaagagaagttggtctaactttccacttattgaaggacgttcccggtctgatctctaagaacattgagaagtccttggacgaagcattcaaaccattgggtatttcagattggaacagccttttttggatcgctcatccaggaggtcctgcaattttagaccaggtcgaaataaagttgggtttgaaagaagaaaagatgagagctacacgtcacgttatgagagaatacggtaatatgtcttctgcttgtgtcttgtttattttggacgaaatgagaaagaaaagtgccaaggatggcgttgctaccactggtgaaggtttagagtggggtgttttgttcggcttcggtcccggtctgaccgttgaaaccgtgtaa

SEQ ID NO: 100 - DNA, 1068 bp, Artificial Sequence
  Synthetic
atgaggcctatatccgtaattgcaggagttcgtggtgagctacccgcccacagatactcacaggctgaagtcacagaagctttcctgactattggtggctatggtgattacgaagaaatcttaagaaagttgcatagaagcgccaaagttgacaatagacactttgtgcttccattggaccaatacccagctttaaaggatttcggtgaagctaacgacttgtttatcgaaaacgctgttgagttgggtagtgctgccgtcgctggtgcattggaagaagctggtctaagaccagaagatgtcgatcttattgtttctaccactgttaccggtgttgctgccccatctatcgaagcaagaattgctggacgtttaggtatgaggcctgatgtcagaagagtcccaatgttcggcttgggttgcgtagccggtgctgccggtgttgctagattgcatgactatttaagaggtgacccagatggtgtcgctgttttggtatccgttgagctgtgttctatgacgtacactgccaacaaacccaccttgccaggtttggttggttcggctctatttgctgacggagctgccgctgtcgttgctgtgggtgaacgtcgtgccgaaaagattaaggcatctggtccagatgtcatcgactccagatcacacttgtatcctgatagtttaagaactatgggatgggacgtgggtgcagatggcttagaactggtgttgtctgctgatttgccagaagtcatagaaagatacttgccagacgatgttaccgagttccttggagctcatagtttgaagttagatgatattggtacctgggtttgtcaccctggtggtccaaaaatcatcgaagcaattgttaattccttaaacttgcccgacgaagctttggaactgacttggagatccctagctgacataggtaacatttcgtcttcttctgtattgcatgttttacgtgacacaatcgctaagaggccagccgctggcccatctgtcatgatggctatgggtccaggtttctgttcagaattagtactgttgagatggcactaa

SEQ ID NO: 101 - DNA, 1173 bp, Artificial Sequence
  Synthetic
atgacacccgctttactgtctcttggaacggccttgccaccacatgtcctagagcaaactgatgcacaggacttgtaccaagctcaacctggtactgatagattgaatgctcgtttattgaggaccgtattcggtgcctcaggtgttgctagaagacacaccgttttgtcggaattggtggaccacgatgccagaaaagactctccatatataactggtgacggtagatttcgtgcaccactgaccggcgctaggaacagaacttacatggaagaagctcctggtttattcgctgctgctgccagagatgcattggctagatgcccagccgttgacccaaccagtatcacggatgtcgtcactgtttcctgtacaggttttttcgctcctggcccagattatcatttggtgagagacttgggtttaaacccagctactagacgttctcacattggttttatgggttgtcatggaggcctaattggtttaagacaagcagctgctatcgctaccgccgacccagacgctgttgtcttgttggtcgctgttgaactatgtaccctgcacttgcgtcctgcaagagatgccgatgccattcgtggtgcagctcttttcgctgatggtgctgccgctgccttgatcggttccagagttccagatggttgtgctcccctattgcaacttgacagattcagaacattagtcattccagacggtgaacaggctatggcttggacaataggtgacagcggctttgaaatgatcttgggtgctgctgttccacaagttttggaggataatattcatgccgcacttgaagctttgttagaaggtccagaaggtgccgtagatagagcttctatcactgattgggctttgcaccctggcggtagaggtattttggacaagttggagcatacgttagatttggccccagaagctttaagagaatctagggatgtactagctaccagaggtaacatgtcatccgttaccgtcctgcacgttctgagacaagtcattgacgaagctcccccaggtgaagatagaactgtctgcgctttggccttcggcccaggtttgactgttgaatccgctctattcactatcccagccagacctgctgcaccagccgcacatgctcacagtgcaactgctgtaccaaccccttaa

SEQ ID NO: 102 - DNA, 675 bp, Artificial Sequence
  Synthetic
atgggatgttacgcagccttccctgctttgcgtgctgccaggcagttttgccaagctgatccaagcgctgttgtcttagtaatttgtgttgaactatgttcacttcacgtgagaacctccaacgacccagatacgatcatgggcagtgctattttcgctgacggtgcagccgccgctgttgtcacttcgagagagcccgaaggtccagacccagttataagattggatcattttgaaacagtcttgactcctgtaggtgaagaagctatggcttggaatatcggtgatgagggtttcgaaatggttttgggtacctatgtgccacacatcattgaagaacatattactggtgctttagaaccactgttggccagagatccatctttagcaggtctaccttacagagacatcacccactgggctattcatccaggaggtagatctatcttggacaaagtcgaatccaagttggagttaactgaagaacaaatgatacccgctcgtgacgttttgagggattacggaaacatgtcttctgctaccgttctattcgtcttgaagcacattttgggtcaaacaccagctgaaagagaggaaagaatctgctccatggcctttggtccaggtttaactgttgaaactggtctattcacaagagtctcacctaccttgtaa

SEQ ID NO: 103 - DNA, 1176 bp, Artificial Sequence
  Synthetic
atggctactgttcaagagattcgtaacgcccagagggcagacggtccagctaccgtgcttgctatcggaacagccactcctgctcattccgtcaatcaagctgattacccagactattacttcagaataaccaaaagtgaacacatgacggaattgaaggaaaagtttaagagaatgtgtgataaatctatgattaagaagagatatatgtacttgaccgaagagatcctaaaggaaaaccccaatatgtgcgcctacatggctccaagcttagatgcaagacaagacattgttgtcgtagaagttccaaaactgggtaaggaagccgctactaaggctatcaaggaatggggtcaacctaaatctaaaattactcacttgattttctgtaccacttcgggcgttgatatgccaggtgctgactatcaattgacaaagttaatcggtttgcgtccatctgtcaagagatttatgatgtaccaacagggttgtttcgcaggcggtaccgttctaagattggctaaggatttagccgaaaacaacaaaggtgctagagttttggtcgtttgttccgaaatcactgctgtaacctttagaggtcccgctgacactcatttggattcattagtcggtcaagctcttttcggtgacggagccgccgcagtcattgttggtgctgacccagatacctctgtagagcgtccattgtatcaactggtttccacttctcaaacgatattgccagactccgatggtgctattgatggacacctaagagaagttggtttaacctttcatttgttgaaagatgtgcccggcctgatctctaagaacattgaaaaatcattgagcgaagccttcgctccattaggtatatccgactggaatagtatcttctggatcgctcaccctggtggtcctgcaattcttgaccaagtcgagtctaagctaggtttgaagggtgaaaagcttaaggctaccagacaggtcttgtccgaatacggtaacatgagctcggcctgcgtattgttcatcttggacgaaatgagaaagaagtctgtcgaagaagctaaggctactacaggtgaaggattagattggggtgttttgtttggtttcggtccaggtttaactgttgaaactgttgtgttgcactctgttcctattaaagcttaa

SEQ ID NO: 104 - DNA, 1173 bp, Artificial Sequence
  Synthetic
atggttacaattgacgaaatcagaaaagcccaaagggcagatggtccagctactatattagctattggcaccgctaaccctcagaattgcatcgagcaatcaacttaccccgattattactttagagtgacgaactcggaacacatggtcgaacttaagcaaaagttcaagcgtatgtgtgaaaaatccatgattaagaagagatatatgtacctaaccgaagaaatcttgaagcaaaacccaaatctgtgtgcttacatggccccatctttggacgctcgtcaagatatggtagttgtcgaggtcccaagattgggaaaagaagccgctgttaaggcaattaaagaatggggtcagcctaagtctaagatcactcatttggttttctgtaccactagcggtgttgacatgccaggtgctgattatcaattaacaaaacttttgggtttgaggccaagcgtaaagagattaatgatgtaccaacaaggttgctttgctggtggcaccgtcttgagattagccaaggacttggctgaaaacaatagaggtgctagagtgctagttgtttgttctgagatcactgccgttaccttcagaggtcctacggatacacacttggacagtctagtcggtcaagccctgttcggtgacggtgctgctgcaatgattataggagctgatccagtggaaaacgtcgaaagaccaatttttaaattggtcagtgccgcacagactttgtgtcccgactcggaaggtgctattgatggtcatttgcgtgaggttggtttaacttttcaccttttgaaggatgttccaggcatcatctctaagaatatcgaaagatgtttggatgatgctttcaaaccactgggtatttccgactggaactccttgttctggattgctcaccctggtggtccagcaatattagaccaagtcgaagaaaagctgaagctaaaggaagaaaaaatgagagctaccagagaagttttgtcagagtacggaaacatgtctagcgcttgcgttgtgttcattttggacgaaatgcgtaaaagatctgctgcacaaggtaagggcactaccggtgaaggtttagagtggggtgtcttgtttggttttggtccaggattgaccgttgaaactgttgtcttacatagtgttgccacatcataa

SEQ ID NO: 105 - DNA, 1188 bp, Artificial Sequence
  Synthetic
atgcctgctggcatgatggccgatctggaagcatttaggaaggctcagagatccgacggtgctgccacgatcttagcaataggtaccgctacaccaccaaacagcgttgatcaaagttcttatcccgactactacttcaaaattactaattctgagcacatgaccgaattgaaggaaaaattccgtagaatgtgtgacaagtcagctattaacaagagatatatgtacctaactgaagaaattcttaaagaaaatccaaaggtgtgcgaatacatggctccatccttggatgcaagacaagatatggtagtcgtcgaagttcccagattaggtaaggacgctgctgccaaggctatcaaagagtggggacaaccaaagtcgaagatcactcatgttatattttgtaccacttctggtgttgatatgccaggtgccgactatcaattgacaaagttgcttggtttacgtcctagtgtcaaaagagttatgatgtaccaacagggatgtttcgctggtggtaccgttttgagagtcgccaaggatttggctgaaaacaacagaggtgctagagtattagtggtttgttcagaaattactgctgttacattcagaggtccatccgacacccacttggattctatggtcggtcaagctttgtttggtgacggcgccgctgctctgatcgtaggtgcagatccagttccacaagttgaaaaaccttgcttcgaaatcatttggactgctcaaacgattttgccagactcggacggtgcaatagatggtcatttgagggaggcaggtctaacctttcacctgttgaaggatgtcccaggcttgatctctaagaacattgaacgttccctagttgaagccttccaacagtttggtatttctgattggaatcaattgttctggatcgctcatccaggtggtcctgctatcttagatcaagtggaaaagaaattgaacttggatcccaaaaagctaagagctactagacaagtgttatcagagtacggcaatatgagctctgcctgtgtccacttcattttagacgaaatgagaaagtcctccagagaaaacggttgttctactacaggcgaaggattagacgttggtgttttatttggtttcggtccaggccttaccgtcgagactgtcgttttgaaatctgttccattgcaataa

SEQ ID NO: 106 - DNA, 1173 bp, Artificial Sequence
  Synthetic
atggcctctatagaagacatcaggagagctcagcgtgcagagggcccagctaccattttggctatcggtacggccacacccgctaactgcgttaaacaatcagaatacccagatttttatttcagaattactgactccgaacatatgactgaactgaaggaaaagttcaaaagaatgtgtgagaagtcgcaaattaagaaacgttacatgcacttaaccgaagaaatcctaaaggaaaatcctaacatgtgtgcttacatggctccttctttggatgcaagacaagatattgtcgtagttgaagtgccaaagttgggaaaggaagccgctgagaaggctattcaagaatggggtcaaccaaaaagtaagatcactcaccttgtcttttgtaccactagcggtgttgacatgccaggttgcgactatcagttgactaaattattgggtttaagaccatccgttaagagaattatgatgtaccaattgggttgtttcgctggaggtaccgtcttaagaatggccaaggatttggctgaaaataacgctggtgccagagttctagtcgtttgttcagaaataaccgcaatcatgttcagaggtccaaacggtagccctattgactctttgataggtcaatttttattcggcgatggtgcagccgctgtcatcgtgggttctgatccagtagttggcgtcgaacgtccattgtttcagctagtttcggctgctcaaacattgttgcctgactcccatggtggtattgactgtcatttgagagaggctggtcttactttccacctgagaaaggatgtcccagctttgatctctaaacacatcggtgaatcccttaaggaagcattcgaccccttaggaatttctgattggaatagcatattttggatcgcccacccaggtggtccagctattttggatcaagtcgagtccacgcttgccttgaagccagaaaaattgcgttctacaagacacgttctatctgaatatggcaacttgagttcggcttgtgttcttttcatcttagatgaaatgagaaaatcatccgctaaggagggtatgtctactaccggtgaaggtttgaactggggtgtgttattcggatttggacctggtttaaccgttgaaactgtggttttgcattctgttgcaataaattaa

SEQ ID NO: 107 - DNA, 1053 bp, Artificial Sequence
  Synthetic
atgactaggatcgccgctgtgcatggagcactggctccccaccgttatgctcaacacgatattaccgacatggttgccaagacgtgtttacctgctggtgctgacagacaggtacttgatagattgcatagaggtgcaagagttgatactagacacacagccctaccattggaacaatacgacggcttgaaagattttggtgctgtcaatgacgctttcatagccggtgctctgccattaggtgccgaggctgtcggtggtgctttggatgccgctggattctcccctcgtgacgttgatttgttgatgtttacctcggtcaccggtattgctgcaccatcagttgatgctagattagttggtagattgggtttgagaagcgacgtaaagagagtcccagttttcggtttgggttgcgttgctggcgccgcaggtatcgctaggcttcacgactacttactaggtagaccagatgacgtcgctgtgttgctatctgttgaactttgttctttgacttttcaacgtgatgacgtttcctctgctaacttggttgccactgctttattcggcgatggtgcagccgctgtcgttgcttgtggtccaagaagaagaccaattggtcctgtcgtagtcgaaacccgttcacatttgtatccagacactgaacaagctatgggctgggacataacaggttccggcttccgtatcgtcctggatgcctctgttccagagttggtgagaaagaacttggcagccgatgttgctggttttttggctgacaatggtttaacaagagaagatattactgcttgggtctgtcacccaggtggtcccaaagttctggaagcagttgaagaagtcttggagttgccagctgacgctttagacatgacctggagaagcttggccgctgttggtaacctaagttctagttctgtattgcatgtattgagagacacccttgctgaaagaccacctccaccaggtacttacggattgctgttagccatgggtcccggtttctgctccgaattagtcttgttgaggtggtaa

SEQ ID NO: 108 - DNA, 1188 bp, Artificial Sequence
  Synthetic
atgcctgctggtatgatggccgacctagaggcatttagaaaagctcaacgtgctgatggccccgccaccatcttagctataggtacggctactccaccaaacgctgttgaccagtctacctacccagattattacttcaaggtgactaatagtgaacatatgaccgaacttaaggaaaagttcaggagaatgtgtgataaatcagctattaagaagagatatatgtacttgacagacgaaatcttgaaggagaacccaaatgtctgcgaatacatggccccttctttggatgcaagacaagacatggttgtcgttgaagtaccaagattaggaaaagaagcagccgctaaggccattaaggaatggggtcaaccaaagtccaaaattactcacgtcatcttttgtactacttcgggtgttgacatgcctggtgctgattatcaattgacaaagttactgggtttgcgtccatccgttaaaagagtaatgatgtaccaacaaggttgtttcgctggtggtacggttttgagagtcgctaaagatttggctgaaaacaatagaggagctagagttctagtcgtgtgctcagaaataaccgctgttactttccgtggtccatctgacacccacttagatagcatggtgggccaggcattgtttggtgacggtgcagccgctttaattgtaggtgctgatcccatcccagaagtcgaaaagccttgttttgagttgctgtggaccgcacaaactattttgccagactctgatggtgctatcgacggacatctgagagaggttggtttgactttccacctattgaaagatgtcccaggcttaatttctaagaacatcgaaaagtccttggttgaagctttccagcaattcggtatctccgactggaaccaactattttggatagcccatccaggtggtcccgccattttggaccaagttgaagtcaagctgaacttagatccaaagaagttgagggcaacccgtcaagttttgggtgaatatggtaatatgtcctctgcttgtgtccactttattcttgatgaaatgagaaagagtagcagagagaagggttgttcaacaactggcgaaggtttggacgttggtgtcttattcggctttggtcctggtttgaccgttgaaacagttgtcttgaaatcagttccacttcaataa

SEQ ID NO: 109 - protein, 719 aa, Unknown
  AAE
MGKNYKSLDSVVASDFIALGITSEVAETLHGRLAEIVCNYGAATPQTWINIANHILSPDLPFSLHQMLFYGCYKDFGPAPPAWIPDPEKVKSTNLGALLEKRGKEFLGVKYKDPISSFSHFQEFSVRNPEVYWRTVLMDEMKISFSKDPECILRRDDINNPGGSEWLPGGYLNSAKNCLNVNSNKKLNDTMIVWRDEGNDDLPLNKLTLDQLRKRVWLVGYALEEMGLEKGCAIAIDMPMHVDAVVIYLAIVLAGYVVVSIADSFSAPEISTRLRLSKAKAIFTQDHIIRGKKRIPLYSRVVEAKSPMAIVIPCSGSNIGAELRDGDISWDYFLERAKEFKNCEFTAREQPVDAYTNILFSSGTTGEPKAIPWTQATPLKAAADGWSHLDIRKGDVIVWPTNLGWMMGPWLVYASLLNGASIALYNGSPLVSGFAKFVQDAKVTMLGVVPSIVRSWKSTNCVSGYDWSTIRCFSSSGEASNVDEYLWLMGRANYKPVIEMCGGTEIGGAFSAGSFLQAQSLSSFSSQCMGCTLYILDKNGYPMPKNKPGIGELALGPVMFGASKTLLNGNHHDVYFKGMPTLNGEVLRRHGDIFELTSNGYYHAHGRADDTMNIGGIKISSIEIERVCNEVDDRVFETTAIGVPPLGGGPEQLVIFFVLKDSNDTTIDLNQLRLSFNLGLQKKLNPLFKVTRVVPLSSLPRTATNKIMRRVLRQFSHFE

SEQ ID NO: 110 - protein, 395 aa, Cannabis Sativa
MGLSSVCTFSFQTNYHTLLNPHNNNPKTSLLCYRHPKTPIKYSYNNFPSKHCSTKSFHLQNKCSESLSIAKNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFI

SEQ ID NO: 111 - protein, 544 aa, Cannabis Sativa
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 112 - protein, 545 aa, Cannabis Sativa
MNCSAFSFWFVCKIIFFFLSFHIQISIANPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 113 - protein, 545 aa, Cannabis Sativa
MNCSTFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGLSYISQVPFAIVDLRNMHTVKVDIHSQTAWVEAGATLGEVYYWINEMNENFSFPGGYCPTVGVGGHFSGGGYGALMRNYGLAADNIIDAHLVNVDGKVLDRKSMGEDLFWAIRGGGGENFGIIAACKIKLVVVPSKATIFSVKKNMEIHGLVKLFNKWQNIAYKYDKDLMLTTHFRTRNITDNHGKNKTTVHGYFSSIFLGGVDSLVDLMNKSFPELGIKKTDCKELSWIDTTIFYSGVVNYNTANFKKEILLDRSAGKKTAFSIKLDYVKKLIPETAMVKILEKLYEEEVGVGMYVLYPYGGIMDEISESAIPFPHRAGIMYELWYTATWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPRHH

SEQ ID NO: 114 - protein, 7 aa, Artificial Sequence
  Synthetic
SGAAPLG

SEQ ID NO: 115 - protein, 12 aa, Artificial Sequence
  Synthetic
AYLGMSSGTSGG

SEQ ID NO: 116 - protein, 4 aa, Artificial Sequence
  Synthetic
DQPA

SEQ ID NO: 117 - protein, 8 aa, Artificial Sequence
  Synthetic
QVAPAELE

SEQ ID NO: 118 - protein, 4 aa, Artificial Sequence
  Synthetic
VVID

SEQ ID NO: 119 - protein, 10 aa, Artificial Sequence
  Synthetic
SGKILRRLLR

SEQ ID NO: 120 - protein, 13 aa, Artificial Sequence
  Synthetic
RGPQIMSGYHKNP

SEQ ID NO: 121 - protein, 13 aa, Artificial Sequence
  Synthetic
RGPQVMDGYHNNP

SEQ ID NO: 122 - protein, 13 aa, Artificial Sequence
  Synthetic
RGPQIMDGYHKNP

SEQ ID NO: 123 - protein, 10 aa, Artificial Sequence
  Synthetic
VDRTKELIKS

SEQ ID NO: 124 - protein, 10 aa, Artificial Sequence
  Synthetic
VDRTKEMIKS

SEQ ID NO: 125 - protein, 101 aa, Cannabis Sativa
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRK

SEQ ID NO: 126 - protein, 28 aa, Artificial Sequence
  Synthetic
MKCSTFSFWFVCKIIFFFFSFNIQTSIA

SEQ ID NO: 127 - protein, 28 aa, Artificial Sequence
  Synthetic
MNCSAFSFWFVCKIIFFFLSFHIQISIA

SEQ ID NO: 128 - protein, 28 aa, Artificial Sequence
  Synthetic
MNCSTFSFWFVCKIIFFFLSFNIQISIA

SEQ ID NO: 129 - protein, 543 aa, Unknown
  AAE
MEKSGYGRDGIYRSLRPPLHLPNNNNLSMVSFLFRNSSSYPQKPALIDSETNQILSFSHFKSTVIKVSHGFLNLGIKKNDVVLIYAPNSIHFPVCFLGIIASGAIATTSNPLYTVSELSKQVKDSNPKLIITVPQLLEKVKGFNLPTILIGPDSEQESSSDKVMTFNDLVNLGGSSGSEFPIVDDFKQSDTAALLYSSGTTGMSKGVVLTHKNFIASSLMVTMEQDLVGEMDNVFLCFLPMFHVFGLAIITYAQLQRGNTVISMARFDLEKMLKDVEKYKVTHLWVVPPVILALSKNSMVKKFNLSSIKYIGSGAAPLGKDLMEECSKVVPYGIVAQGYGMTETCGIVSMEDIRGGKRNSGSAGMLASGVEAQIVSVDTLKPLPPNQLGEIWVKGPNMMQGYFNNPQATKLTIDKKGWVHTGDLGYFDEDGHLYVVDRIKELIKYKGFQVAPAELEGLLVSHPEILDAVVIPFPDAEAGEVPVAYVVRSPNSSLTENDVKKFIAGQVASFKRLRKVTFINSVPKSASGKILRRELIQKVRSNM

SEQ ID NO: 130 - DNA, 303 bp, Cannabis Sativa
atggcagtgaagcatttgattgtattgaagttcaaagatgaaatcacagaagcccaaaaggaagaatttttcaagacgtatgtgaatcttgtgaatatcatcccagccatgaaagatgtatactggggtaaagatgtgactcaaaagaataaggaagaagggtacactcacatagttgaggtaacatttgagagtgtggagactattcaggactacattattcatcctgcccatgttggatttggagatgtctatcgttctttctgggaaaaacttctcatttttgactacacaccacgaaag

SEQ ID NO: 131 - protein, 307 aa, Unknown [sequence omitted]

SEQ ID NO: 132 - DNA, 924 bp, Artificial Sequence
  Synthetic
atgtcagaagccgcagatgtcgaaagagtttacgccgctatggaagaagccgccggtttgttaggtgttgcctgtgccagagataagatctacccattgttgtctacttttcaagatacattagttgaaggtggttcagttgttgttttctctatggcttcaggtagacattctacagaattggatttctctatctcagttccaacatcacatggtgatccatacgctactgttgttgaaaaaggtttatttccagcaacaggtcatccagttgatgatttgttggctgatactcaaaagcatttgccagtttctatgtttgcaattgatggtgaagttactggtggtttcaagaaaacttacgctttctttccaactgataacatgccaggtgttgcagaattatctgctattccatcaatgccaccagctgttgcagaaaatgcagaattatttgctagatacggtttggataaggttcaaatgacatctatggattacaagaaaagacaagttaatttgtacttttctgaattatcagcacaaactttggaagctgaatcagttttggcattagttagagaattgggtttacatgttccaaacgaattgggtttgaagttttgtaaaagatctttctcagtttatccaactttaaactgggaaacaggcaagatcgatagattatgtttcgcagttatctctaacgatccaacattggttccatcttcagatgaaggtgatatcgaaaagtttcataactacgctactaaagcaccatatgcttacgttggtgaaaagagaacattagtttatggtttgactttatcaccaaaggaagaatactacaagttgggtgcttactaccacattaccgacgtacaaagaggtttattgaaagcattcgatagtttagaagactaa

SEQ ID NO: 133 - protein, 398 aa, Cannabis Sativa
MGLSLVCTFSFQTNYHTLLNPHNKNPKNSLLSYQHPKTPIIKSSYDNFPSKYCLTKNFHLLGLNSHNRISSQSRSIRAGSDQIEGSPHHESDNSIATKILNFGHTCWKLQRPYVVKGMISIACGLFGRELFNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 134 - protein, 323 aa, Artificial Sequence
  Synthetic
MSAGSDQIEGSPHHESDNSIATKILNFGHTCWKLQRPYVVKGMISIACGLFGRELFNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 135 - protein, 545 aa, Cannabis Sativa
MNCSAFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGMSYISQVPFVVVDLRNMHSIKIDVHSQTAWVEAGATLGEVYYWINEKNENFSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGVGMYVLYPYGGIMEEISESAIPFPHRAGIMYELWYTASWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 136 - protein, 517 aa, Artificial Sequence
  Synthetic
NPQENFLKCFSEYIPNNPANPKFIYTQHDQLYMSVLNSTIQNLRFTSDTTPKPLVIVTPSNVSHIQASILCSKKVGLQIRTRSGGHDAEGMSYISQVPFVVVDLRNMHSIKIDVHSQTAWVEAGATLGEVYYWINEKNENFSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGVGMYVLYPYGGIMEEISESAIPFPHRAGIMYELWYTASWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 137 - DNA, 1551 bp, Artificial Sequence
  Synthetic
aacccgcaagaaaactttctaaaatgcttttctgaatacattcctaacaaccctgccaacccgaagtttatctacacacaacacgatcaattgtatatgagcgtgttgaatagtacaatacagaacctgaggtttacatccgacacaacgccgaaaccgctagtgatcgtcacaccctccaacgtaagccacattcaggcaagcattttatgcagcaagaaagtcggactgcagataaggacgaggtccggaggacacgacgccgaagggatgagctatatctcccaggtaccttttgtggtggtagacttgagaaatatgcactctatcaagatagacgttcactcccaaaccgcttgggttgaggcgggagccacccttggtgaggtctactactggatcaacgaaaagaatgaaaattttagctttcctgggggatattgcccaactgtaggtgttggcggccacttctcaggaggcggttatggggccttgatgcgtaactacggacttgcggccgacaacattatagacgcacatctagtgaatgtagacggcaaagttttagacaggaagagcatgggtgaggatcttttttgggcaattagaggcggagggggagaaaattttggaattatcgctgcttggaaaattaagctagttgcggtaccgagcaaaagcactatattctctgtaaaaaagaacatggagatacatggtttggtgaagctttttaataagtggcaaaacatcgcgtacaagtacgacaaagatctggttctgatgacgcattttataacgaaaaatatcaccgacaaccacggaaaaaacaaaaccacagtacatggctacttctctagtatatttcatgggggagtcgattctctggttgatttaatgaacaaatcattcccagagttgggtataaagaagacagactgtaaggagttctcttggattgacacaactatattctattcaggcgtagtcaactttaacacggcgaatttcaaaaaagagatccttctggacagatccgcaggtaagaaaactgcgttctctatcaaattggactatgtgaagaagcctattcccgaaaccgcgatggtcaagatacttgagaaattatacgaggaagatgtgggagttggaatgtacgtactttatccctatggtgggataatggaagaaatcagcgagagcgccattccatttccccatcgtgccggcatcatgtacgagctgtggtatactgcgagttgggagaagcaagaagacaacgaaaagcacattaactgggtcagatcagtttacaatttcaccaccccatacgtgtcccagaatccgcgtctggcttacttgaactaccgtgatcttgacctgggtaaaacgaacccggagtcacccaacaattacactcaagctagaatctggggagagaaatactttgggaagaacttcaacaggttagtaaaggttaaaaccaaggcagatccaaacaacttttttagaaatgaacaatccattcccccgctacccccgcaccatcac

SEQ ID NO: 138 - protein, 5 aa, Artificial Sequence
  Synthetic
RSGGH

SEQ ID NO: 139 - DNA, 30 bp, Artificial Sequence
  Synthetic
gaacagaaactcattagcgaagaagatctc

SEQ ID NO: 140 - protein, 10 aa, Artificial Sequence
  Synthetic
EQKLISEEDL

SEQ ID NO: 141 - protein, 595 aa, Artificial Sequence
  Synthetic
MVQIIHKAPLGDMAESELFYGSIPDFMRSSRFADDDTRISVVDYDTDKAMTLARVFKVSGMLRAQFFHTYDVGKKKDGDANPKVIFYVGNTADNLACHIALHDLGAIISPASTAYDVNDLLHQINVVDAALIVAEAARADVAREAVAKAGDKFKHVKVVVFEELLEQNRRVRPNLIRVAPIVHLSKEQAYTTLAYLGMSSGTSGGVPKAVELTHFAMTSNVQQTAKNAPNLVDDDTVCSAVIPTSHIYGLALFMLHMPFLGAKVVYHKKFDLVEMLEGQKKHGVNYWVLVPPIIVALAKHPIIDRYLDSIRANLKTITSGAAPLGGNVVDAVQTRFTGNTRGTLPNNRRIVIYQGYGLTETAPIACLCDPLWDNLNVVTVGTLVPNTEARIVDENGDDQPAFEVTDARALGDAVRRGDKIPSGELYLRGPQIMSGYHKNPKSTEESFEYVDYKAEGLRHYQDRWLKTGDVAVIDNFGRIQIVDRTKELIKSMSKQVAPAELEALLLSHPDVVDVAVIGVWQEEKATESARAFLVVRDPKVDVVAIKKWMDEQVPSYKRLYGGVVVIDAIPKNPSGKILRRLLRQRKDDVVQGLDQ

SEQ ID NO: 142 - protein, 595 aa, Artificial Sequence; identical to SEQ ID NO: 141
  Synthetic

SEQ ID NO: 143 - protein, 403 aa, Leersia perrieri
MAPVPANGAATATATTQEIRRAQRADGPATVLAIGTANPETYVSQDEYADYYFRITKSEHLPELKDKLRRICNKSGIDKRFMYVNEDVMEAHPEFADRNQSSLNARVEIASKAVPELAAAASAKAIAEWGRPATDITHLIFSTYSGVKAPSGDRLLASLLGLRPNVSRTTLSLHGCYGGGRALQLAKELAENNRGARVLVACAEMTLIAFYGPEVGCNDTIVGQALFGDGSGAVIVGADPVDAAGERPLFEMAFASQTTVPDSEGAITMQHTKGGMDYHIGSGIPEMLAGNIERCLADAFDSIGVAADWKDLFWAVHPGGRRILDLIEEALGLDNGAMAASRQVLREFGNMSGTTVIFVLNELRRRFKANGAEGADWGALMAFGPGVTIETMLLRVAAGLKGN

SEQ ID NO: 144 - protein, 406 aa, Oryza glaberrima
MAPVPATAAAAAAPAAVVSTHEIRRAQRADGPATVLAIGTANPETCVPQDEYADFYFRVTKSEHLPELKNKLRRICNKSGIEKRFMFVNDDVMEAHPEFADRHLTSLDARVEIVSKVVPELAAAASAKAIAEWGRPATDITHLIFSTYSGVKAPGGDRLLASLLGLRPTVSRTVLSLHGCYGGGRALQLAKELAENNRGARVLVACAESTLIAFYGPEVGCNDTIIGQALFGDGSGAVIVGADPVGAVERPLFEMAFASQATVPDSEGAITMQHKKGGMDYHIGGGVPEMLAGSIERCLADAFGAIGVAARWRDLFWAVHPGGRRILDLIEEALGLDNGAMAASRQVLREYGNMSGTTVIFVLNELRRRFVADGAEGADWGALMAFGPGVTVETILLRVGSGLKGN

SEQ ID NO: 145 - protein, 390 aa, Oncidium hybrid cultivar
MPSLESTKKAPRSHGFASILAIGRANPENFVEQNAYPDLFFRATNSKHLVNLKKKFQRICDKTAIRKRHFAWNEEFITANPCLQTFMDNSLNVRQEFAITYIPKLGAEAATKAIQEWGQPKSRITHLIFCTTSGMDLPGADYQLTQILGLNPNVERVMLYQQGCFAGGTTLRLAKCLAESRKGARVLVVCAETTAVLFRAPSEEHQDDLVTQALFADGASALIVGADPDEAANERASFIIVSTSQVLLPDSAGAIGGHVSEGGLLATLHRDVPQIVSKNVGKCLEEAFTPLGISDWNSIFWVPHPGGRAILDLVEERVGLKPEKLLVSRHVLAEYGNMSSVCVHFALDEMRRRSAKEGKATTGEGLDWGVLFGFGPGLTVETVVLHSVPI

SEQ ID NO: 146 - protein, 396 aa, Panicum hallii
MGSAPATVGEIRRAQRADGPAAVLGIGTANPPTCVAQDDYPDYYFRVTSSEHLTDLKAKLTRICKKSGIKQRFMHLNEELLAANPDFTDRALPSLDARVDIASAAVPELAASAAAKAIAEWGRPATEITHLIFSTYSGARAPSADRRLASLLGLSPTVSRTMLNLHGCYGGGRSLQLAKELAENNRGARVLVACSEITLIAFYGPEGGCPDNILGQALFGDGAGAVIIGADPVSPVERPLFEMAFASQTTIPETEDAISMEITKGGMEYHISNQVPRLLGSNVERCLIDAFDALGVSAKWNDLFWAIHPGGRAILDHIEGVLGLDDGKLAASRHVLSQFGNMSGTTVIFVLDELRRRRAAKQEGEAPEEWGVVMAFGPGITIETMVLHAPSNLGGN

SEQ ID NO: 147 - protein, 401 aa, Oryza brachyantha
MAPVPATAAAGSSTREIRRAQRADGPAAVLAIGTANPEKCVTQDEYADFYFRITNSDHLPELKDKLSRICNKSGIEKRFMYVSDELMEAHPEFADRHLPSLDARVEIASKNVPELAAAASAKAIAEWGRPATDITHLIFSTYSGVKAPSGDRLLASLLGLRPTVSRTVLSLHGCYGGGRALQLAKELAENNRGARVLVACAESTLIAFYGPEVGCNDIIVGQALFGDGSGAVIVGADPVDAVERPLFEMAFASQTTIPDSEGAITMQYMKGGMDYHIASGVPEMLAGNVERCLAHAFDSVGVAAKWKDLFWAVHPGGRRILDLIEEALGLENGAMAASRQVLSEFGNMSGTTVIFVLNELRRRFEADGAEGADWGALMAFGPGVTVETVLLRVASGLKPNQ

SEQ ID NO: 148 - protein, 398 aa, Trichophyton rubrum
MPASRCASNPLVAPGLFIVGLGSQYPPYLLDHEKLTCFAGRFHDIRRPGLQKLLQINASTGIETRSSIRSYETGFACDPVPPSIADLDELFRRDGVDLAVQACMKAMKEAGVLPEQITHTVSVTCTNQGNPGYDLLVNERLGLPERTSRILLHGVGCAGGLSIMRVASQVACGATMRGRKACILVYACELCTPNVRHDLAEAEQCTDLSKVNIAGALFSDAAAAFILCNKTALEESSASPIFELIEWDNALIPDTMQHLTCYTDPYGFRSVLTKDIPTYAKGAIGPMFHKLLPSYEEQVLAADIHLGIDDFDWAVHPGGKALIDGVQETMQLTEDQLQASREIYRTRGNSSSPTILSVLDRLRTYEKQRGHVVAASFGPGMAIEMVMLKRCEVAGGGQ

SEQ ID NO: 149 - protein, 398 aa, Trichophyton verrucosum
MPASICANSPLVAPGLFIVGLGSQYPPYLLDHEKLTCFAGRFYDIRRPGLQKLLQINASTGIETRSSIRSYETGFACGPVPPSIADLDELFRRDGVDLAVQACMKAMKEAGVLPEQITHTVSVTCTNQGNPGYDLLVNERLGLPERTSRILLHGVGCAGGLSIMRVASQVACGATMRGKPACILAYACELCTPNVRHDLAEAEQCTDLSKVNIAGALFSDAAAAFILCNKTALEEVNASPIFELIEWDNALIPHTMQNLTCYTDPYGFRSVLSKDIPMYAKGAIGPMFHKLLPLYEEQVSAVDKHLSIDDFDWAVHPGGKALIDGVQETMQLTEDQLRASREIYKTRGNSSSPTILSVLDRLRTYEKNRGHVVAASFGPGMVIEMVMLKRCERNFPTA

SEQ ID NO: 150 - protein, 398 aa, Trichophyton rubrum; identical to SEQ ID NO: 148

SEQ ID NO: 151 - protein, 398 aa, Trichophyton tonsurans
MPASKCANSPLVAPGLFIVSLGSQYPPYLLNHEKLTCFAERFYDIRRPGLRKLLQINASTGIETRSSIRCYETGFACDSVPPSIADLDELFRRDGVDLTVQACMKAMKEAGVLPEQITHTVGVTCTNQGNPGYDLLVNEKLGLPERTSRILLHGVGCAGGLSIMRVASQVACGETMRKRPACILAYACELCTPNVRHDLAEAEQCTDLSKVNIAGALFSDAAAAFILCNRTALEGINASPIFELIEWDYALIPDTMQHLTSYTDPYGFRSVLTKDIPTYARAAIGPMFHRLLPSYEEQVFAADMQLGVVNFDWAVHPGGKALIDGIQETMQLTEDQLRASREIYRTRGNSSSPTILSVLDRLRTYEKKRGHVVAASFGPGMAIEMVMLKRCEVAGGER

SEQ ID NO: 152 - protein, 389 aa, Corchorus capsularis
MLQETRPGVATILAIGTANPPDCFCQSEYPDFYFQLTNSQHMTQLKQKFQRICERSAIQKRYMHLSEDMIKENPNLSIYRAPSLDVRQEILITEVPKLGKEAALKAIKEWGQPLSNITHLIFCTSCCATAPTADYHFANLIGLKPSIQKFFIYGQGCYAAGTALRLSKDLVENNVDSRVLIVCSELMLGCFHAPSETHLDILVGSAIFSDGAAALIVGANPDTNKNERPLFEIISANQTVIPDSETMMHGKICEMGINYYISKELPKYIANNIEQCLIEMFTPFGINDWNTLFYAVHNGGPAVLRGIEEKLGLDKDKLEASWHVLREYGNMWSPSVLFALDKMRKMSIKQGKSTTGQGLEWGVLLALGPGLTVETVGLRSCAVVGYACI

SEQ ID NO: 153 - protein, 391 aa, Microcystis aeruginosa
MPYIIETATGFPEHYYPQEVLEVNIRNHCANLLQDYCLRNHLDFQEQTFFDLEQIHRFFSNVKIQGRYFTIPLDEFDVDNPPGIAQPFRQMVDLTMDLVTSTVTNLLKKAALSPKEISLVTSVTVLPSVPSLESLLLNRLDFSLDIKRQALSGVGCLGGAQGLARVNDYLQGHPTEAAILFTTDPSSGLWQGSIHSDLTELLGQLPEDPSQYSNIIMTLVVAALFGDGVGTVLLAGDEHPLVKQGKAKLKIIGTQSLLMPHTEHLMALPLTDYGFRQILRPEVSDYVKGGVRKAVTSLLEKTGVSLEEIVCWMVHPGGPKILDAIVEEFQLEPDVLQVSWDILAEIGNIASATILCILDETLSRPHPPTGSYGLIISMGPGFAQEAILVQF

SEQ ID NO: 154 - protein, 403 aa, Leersia perrieri
MGSQGEYYNKEGRGQAAILGIGSAVPPYELPQSSFPDYYFDVSNSNHRQDLKAKFAKICERTMIEKRCVYMSEEFLRSNPSVTAYSSPSIDVRQRLTDATVPELGAAAARVAIADWGRPASEISHLVMCSTVSGCMPGADYEVVKLLGLPLSTKRCMMYHIGCHGGGTVLRIAKDIAENNPGARVLVVCSEVISMALRGPSDSNMGNLVGQALFGDAGAAVVVGTDPVESCGERALFEMVAAMQDIIPDTEEMVVAKLREDGLLYSLHRDVPVHIEANIEAIVNKSGVGAKAADWNEDVFWLVHPGGRDILDRVARRLGLRHDKVEVSREVMRKHGNTLSSCVVIAMEEMRRRSAERGMGTAGEGLEWGLLFGFGPGLTVETILLRAPLTHPPPCAHAAVRPQ

SEQ ID NO: 155 - protein, 396 aa, Arabis gemmifera
MVMAAGASSLDEIRKAQRANGPAGILAIGTANPENHVLQAEYPDYYFRITNSEHMTDLKEKFKRMCDKSMIRRRHMHLTEDFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 156 - protein, 396 aa, Ipomoea purpurea
MSTTITVLTDTWSHRAKRLEGDAKILAIGTATPANWVDQTTYPDFYFRITNSEHLLEHKEKFKRICNKSKIMKRHLVITEELLKKNPNLCTYNEASLNTRQDILVSEVPKLGKEAAMKAIKEWGRPISEITHLVFCTTSGVDMPGADFQLTKLLGLNSSVKRLMMYQQGCNAGAAMLRLAKDLAENNKGARVLVVCSEVMLSVFRGPSLQQEDNLLAQCLFGDGSAAVIVGTEPRPGLETPLFELVSAAQTTIPDTDFHLKLHLREMGLTFHCSKAVPSLITQNVEDCLVKAFEPFGISDWNSIFWILHPGGNAILDGVEEKLGLEPEKLRASRDVLSQYGNLTSACVLFILDEVRKKSKKQQQMTTGEGLEWGVVFGFGPGLTIDTIVIRSVPIN

SEQ ID NO: 157 - protein, 390 aa, Aegilops tauschii
MTVEEVRKAQRAEGPATVLAIGTATPANCVYQADYPDYYFKITKSDHMADLKEKFKRMCDKSQIRKRYMHLTEEILQDNPNMCAYMAPSLDARQDIVVVEVPKLGKAAAQKAIKEWGQPRSKITHLVFCTTSGVDMPGADYQLTKMLGLRPSVKRLMMYQQGCFAGGTVLRLAKDLAENNRGARVLVVCSEITAVTFRGPHESHLDSLVGQALFGDGAAAVIVGADPDMSVERPLFELVSASQTILPDSEGAIDGHLREVGLTFHLLKDVPGLISKNIERALEDAFKPLGIDDWNSVFWIAHPGGPAILDMVEAKVNLNKERMRATRHVLSEYGNMSSACVLFIMDEMRKRSAEDGHTTTGEGMDWGVLFGFGPGLTVETVVLHSVPITI

SEQ ID NO: 158 - protein, 389 aa, Corchorus olitorius
MVSVEEIRRAQRADGPATILAIGTSTPPYCVEQSTYPGYYFRITKSEHKTELKDKFKRICEKSCVKRRYMYLTEEVLKENPNMCAHMAPSLDARQDMAIVDVPKLGKEAAAKAIKEWDQPKSKITHLIFHTTSGAEMPGADYQLTKLLGLRPSVKRFMMYQQGCFAGGTVIRMAKDLAENNRGARVLVVCSEITAVTFRGPSETNPDGLVGQALFGDGAAAIIIGADPIPEVEKPLFQLVTAGQSILPDSDGAISGQLREAGLTLHLVREVPNLIAKNIEDSLIEAFEPLGISDWNSIFWIAHPGGPAILDKIEAKLALKPERLRATRHVLSEYGNLSSASVLFILDEMRKSSREKGFSTTGEGLDWGVLFGFGPGLTVESVVLHSVPA

SEQ ID NO: 159 - protein, 396 aa, Ipomoea purpurea
MSTTITVLTDTWSHRAKRLEGDAKILAIGTATPANWVDQTTYPDFYFRITNSQHLLEHKEKFKRICNKSKIMKRHLLITEELLKKNPNLCTYNEASLNTRQDILVSEVPKLGKDAAMKAIKEWGRPISEITHLVFCTTSGVDMPGADFQLTKLLGLNSSVKRLMMYQQGCNAGAAMLRLAKDLAENNKGARVLVVCSEVMLSVFRGPSLQQEDNLLAQCLFGDGSAAVIVGTEPRPGLETPLFELVSAAQTTIPDTDSYLKLQLREMGLTFHCSKAVPSLITQNIEDCLVKAFEPFGISDWNSIFWILHPGGNAILDGVEEKLGLEPEKLRASRDVLSQYGNLTSACVLFILDEVRKKSKKQQQMTTGEGLEWGVVFGFGPGLTIDTVVIRSVPIN

SEQ ID NO: 160 - protein, 398 aa, Trichophyton soudanense; identical to SEQ ID NO: 148

SEQ ID NO: 161 - protein, 398 aa, Trichophyton rubrum; identical to SEQ ID NO: 148

SEQ ID NO: 162 - protein, 402 aa, Aspergillus bombycis
MAPLLHGTPPPELRIHNDVPLSKRVVSVVGTGAHYPSYEFPSDELEKLISAAHDPNDPAIRKTLHINEKSRIQYRYTAVPLDDPYWSGPKLPDVAGCDALFRKYGVPVAEEAARKALADWNGSLNDITHIVVVTCTNTANPGLDYMICERLGLHKNVQRTLLHGVGCAGGVSALRTANELLLGAAFQGRPGRALVVACEICTIFFRSMLEDIVKTQEANVAMALFGDGASAMVLSNGIGPETFERAPLWNILNSRTTLLEDSLSSLQFNIHPNGYNPVITKDVPGQTSAALPSGFHDLIASTPSLCSDKSNFDPSSYDWALHPGGYSIAVLAQSALGITEHHLRKTYDVYRLRGNTSSSTVISVINELAKEQDTPESGRGKVIVAAFGPGITMEMAVMARPA

SEQ ID NO: 163 - protein, 395 aa, Dichanthelium oligosanthes
MGSAPATVGEIRRAQRADGPAAVLGIGTANPPTCMAQDDYPDYYFRVTNSEHLTDLKAKLTRICKKSGIKQRFMHLNEELLAANPDFTDRKLPSLDARVDIASAAVPELAASAAAKAIAEWGRPATEITHLIFSTYSGARAPSADRRLASLLGLSPTVSRTILNLHGCYGGGRSLQLAKELAENNRGARVLVACSEITLIAFYGPEGGCPDNILGQALFGDGAGAVIIGADPVSPVERPLFEMAFASQTTIPETEDAISMEINKGGMEYHISNQVPRLLGCNVERCLIDAFDALGVTAKWNDLFWAIHPGGRAILDHIEGVLGLDDGKLAASRHVLSEFGNMSGTTVIFVLDELRRRQAAKQEGETPEWGVMMAFGPGITIETMVLHAPGSLDAY

SEQ ID NO: 164 - protein, 399 aa, Trichophyton violaceum
MMPASRCASNPLVAPGLFIVGLGSQYPPYLLDHEKLTCFAGRFHDIRRPGLQKLLQINASTGIETRSSIRSYETGFACDPVPPSIADLDELFRRDGVDLAVQACMKAMKEAGVLPEQITHTVSVTCTNQGNPGYDLLVNERLGLPERTSRILLHGVGCAGGLSIMRVASQVACGATMRGRQACILVYACELCTPNVRHDLAEAEQCTDLSKVNIAGALFSDAAAAFILCNKTALEESSASPIFELIEWDNALIPDTMQHLTCYTDPYGFRSVLTKDIPTYAKGAIGPMFHKLLPSYEEQVLAADIHLGIDDFDWAVHPGGKALIDGVQETMQLTEDQLQASREIYRTRGNSSSPTILSVLDRLRTYEKQRGHVVAASFGPGMAIEMVMLKRCEVAGGGQ

SEQ ID NO: 165 - protein, 398 aa, Trichophyton equinum
MPASKCANSPLVAPGLFIVSLGSQYPPYLLNHEKLTCFAERFYDIRRPGLRKLLQINASTGIETRSSIRCYETGFACDSVPPSIADLDELFRRDGVDLTVQACMKAMKEAGVLPEQITHTVGVTCTNQGNPGYDLLVNEKLGLPERTSRILLHGVGCAGGLSIMRVASQVACGETMRKRPACILAYACELCTPNVRHDLVEAEQCTDLSKVNIAGALFSDAAAAFILCNRTALEGINASPIFELIEWDYALIPDTMQHLTSYTDPYGFRSVLTKDIPTYARAAIGPMFHRLLPSYEEQVFAADMQLGVVNFDWAVHPGGKALIDGIQETMQLTEDQLRASREIYRTRGNSSSPTILSVLDRLRTYEKKRGHVVAASFGPGMAIEMVMLKRCEVAGGER

SEQ ID NO: 166 - protein, 398 aa, Arthroderma benhamiae
MPASKCANSPLVAPGLFIVGLGSQYPPYLLDHEKLTCFAGRFYDIRRPGLQKLLQINASTGIETRSSIRSYETGFACGPIPPSIADLDELFRQDGVDLAVQACMKAMKEAGVLPEQITHTVSVTCTNQGNPGYDLLVNERLGLPERTSRILLHGVGCAGGLSIMRVASQVACGATMRGKPACILAYACELCTPNVRHDLAEAEQCMDLIKVNIAGTLFSDAAAAFILCNKTALEEVNASPIFELIEWDNALLPDTMQHLTCYTDPYGFRSVLSKDIPTYAKGAIGPMFHKLLPSYKEQVSAADKHLGIDDFDWAVHPGGKALIDGVQETMQLTEDQLRASREIYKTRGNSSSPTILSVLDRLRTYEKNRGHVVAASFGPGMVIEMVMLKRCERNSPTA

SEQ ID NO: 167 - protein, 389 aa, Corchorus olitorius
MMSVEEIRRAQRADGPATILAIGTSTPPYCVEQSTYPDYYFRITKSEHKTELKDKFKRICEKSCVKRRYMFLTEEVLKENPNMCAHMAPSLDARQDMAIVDVPKLGKEAAMKAIKEWDQPKSKITHLIFHTTSGAEMPGADYQLTKLLGLRPSVKRFMMYQQGCFAGGTVIRMAKDLAENNRGARVLVVCSEITAVTFRGPSETNPDGLVGQALFGDGAAAIIIGADPIPEVEKPLFQLVTAGQSILPDSDGAISGQLREAGLTLHLVREVPNLIAKNIEDSLIEAFEPLGISDWNSIFWIAHPGGPAILDKIEAKLALKPERLRATRHVLSEYGNLSSASVLFILDEMRKSSREKGFSTTGEGLDWGVLFGFGPGLTVESVVLHSVPA

SEQ ID NO: 168 - protein, 398 aa, Microsporum gypseum
MSASENSSNPPVPPGLFIVGLGSQYPPYLLDHEMLTRFAGRFYDTQRPGLHKLLQINTSTGIETRSSIRSYETGFACNSVPPSIADLDELFRQDGVDLAVQACTKVMKEAGILREQITDTVSVTCTNQGNPGYDLLVNERLGLPERTSRILLHGVGCAGGLSIMRVASQVACGATMRGKPACILAYACELCTPNVRHDLAEAEQCMDLSEVNVAGALFSDAAAAFILCNEAALKEIKASPIFELVEWDNALIPGTMQHLVCYTDPYGFRSTLAKDIPKYAKEAVGPMFRKLLPSYEGQVFSKDKHLDTDDFDWALHPGGKALIDGVQETMQLMDDQIRASREIYRTRGNSSSPTVLSVLDRLRTYEKRRDHVVAASFGPGLVIEMAMLKRCDIAGSRR

SEQ ID NO: 169 - protein, 406 aa, Aspergillus arachidicola
MAPLFHGTPPPEIRNHNDDSLSKRVISVVGTGAHYPPYELRSDELEKLISAFHDPEDPAARKTLYINEKSKIQYRRTAVPFDDPFWSDPKLPDIADCDVLFRKYGVPVAEEAARKALADWNGSFNDITHVVVVTCTNTANPGLDYMICERLGLRKNVQRTLLHGVGCAGGAAALRTANELLLGAAFQGKPGRALVVACEICTIFFRSMLEDIVKAQEANIAMTLFGDGASAMVLSNGICPKTSERAPLWNILNCRTTLLEDSVSSIQFNIRPHGYHPVITKEVPGQTSAALPSGFQDLISSTPSLCSDKSNFDPSSYDWALHPGGYSIAVLAQNALGITEHHLRKTYEVYRLRGNTSSSTVISVVNELAREQGTPESGRDKVIVAAFGPGITMEMAVMARPVYSAT

SEQ ID NO: 170 - protein, 398 aa, Trichophyton mentagrophytes
MPASKCANSPLVAPGLFIVGLGSQYPPYLLNHEKLSCFAERFYDIRRPGLQKLLQINASTGIETRSSIRPYETGFACDSVPPSIADLDELFRRDGVDLAVQACMKAMKEAGVLPEQITHTVGVTCTNQGNPGYDLLVNEKLGLPERTSRILLHGVGCAGGLSIMRVASQVACGATMRKRPACILAYACELCTPNVRHDLAEAEQCTDLSKVNIAGALFSDAAAAFILCNRTALEGINASPIFELIEWDHALIPNTMQHLTSYTDPYGFRSVLTKDIPTYARAAIGPMFHRLLPSYEEQVFAADMQLGVVDFDWAVHPGGKALIDGIQETMQLTEDQLRASREIYRTRGNSSSPTILSVLDRLRTYEKKRGHVVAASFGPGMAIEMVMLKRCEVAGGER

SEQ ID NO: 171 - protein, 402 aa, Aspergillus nomius
MEPLLHGTPPLALRINNDVPLSKRVVSVVGTGAHYPSYEFPSDELEELISGVHDPNDPAIRKTLHINEKSRIQCRYTAVPLDDPFWTDPKLPDVADCDVLFRKYGVPVAEEAARKALADWNGSLKDITHLVVVTCTNTANPGLDYLICERLGLHRNVQRTLLHGVGCAGGVSALRTANELLLGAAFQGRPGRALVVACEICTIFFRSMLEDIVKTQEANVAMALFGDGASAMVLSNGICTKPFERAPLWNILNSRTTLLEDSLSSLQFNIRPSGYNPVITKDVPGQTSAALPSGFQDLIASTPSLCSDKSNFDPSSYDWALHPGGYSIAVLAQSALGITKHHLRKTYDVYRLRGNTSSSTVISVINELAKEQDTPESGRDKVIVAAFGPGITMEMAVMARPT

SEQ ID NO: 172 - DNA, 1179 bp, Artificial Sequence
  Synthetic
atgtctatggagaacgtggaagctttcggcaaggcacaacgtgccgatggtcaggcttcaatactagctatcggtaccgccaatccacctaacattgtatatcaatcgacatttccagactactacttcggtatcacgaataacgaacacaaaattgatctgaaggaaaaatttagaagaatttgtgaaaagtccatggttactaagaggcatatgcaccttaccgaagaaatcttaaaagagaatcccaacatgtgcgcttacagagctccaagcatggactctcgtcatgatattatcagagaagaagttccaagattgggtaaggaagccgctgttagagctattaacgagtggggaagatccaagtctgaaattactcacttggtcttctgtactaccagtggtgtcgacatgcctggtgcagattatcaattaatgagattgttgggattgcgtccatctgttaagagagtcatgctttcccatcaaggttgtttcgcaggcggtactgttttgagactagctaaagacttggctgaaaacaataggggtgccagagtgctagttgtctgctcagaaaccactgctgttacctttagaggtccagatcacacaagattcgacaatttggtcggtcaagctttatttgcagatggtgctgccgctttagtcgtcggtgctgacgccgttcaaggtttggaaactccatgtttccacttgttatggaacgcacaaaccatattgcccgaatctgaaggagctattgaaggtcacttgagagaggttggcttaacattccaactgttacattcagtaccacagttgatctcagataacatcgaggctgccttgaaggaagctttcaggcatagtggtgtttctgactggaacgaccttttttggatagctcatcctggtggtccagccatcttggatgctgttgaatccaagcttcaattggaccctaagaaactaagagctactagacacgttctgtcggaatacggtaacatgtcttccgcctccgtgttgttcgttttagatgagatgcgtaaaggttctcgtagaggtggttgtgcaaatactggtgaaggcctggatctaggtgtcttgttcggttttggtccaggcttgacggttgaaaccgtcgtattgagatctgttagattgcaataa

SEQ ID NO: 173 - DNA, 1212 bp, Artificial Sequence
  Synthetic
atggcaccagtacccgccaacggcgctgctaccgctacagccactacgcaggaaattagacgtgctcaaagggctgacggacctgccaccgtgctggctatcggtactgcaaatccagagacttatgtctcccaagatgaatacgctgactactattttagaataaccaagagtgaacacctaccagaattaaaagataagttgagaagaatttgcaacaagtcaggtatcgataaaagattcatgtacgttaacgaagacgttatggaagcacatccagaatttgctgaccgtaatcaatcgtctttgaacgctagagtcgaaattgcttctaaggccgttcctgaattggccgctgccgcttctgcaaaggccatcgctgagtggggtagaccagctactgatatcactcaccttattttctcaacatactccggtgttaaagctccaagcggtgacagattattggcttccttgttgggtttgaggccaaatgtctctcgtaccaccttatctttacatggttgttacggcggtggaagagccctacaattggcaaaggaactggctgaaaacaacagaggtgccagagttttggttgcttgtgctgagatgactttaatagctttctatggtccagaagtcggttgtaatgatactatcgtaggtcaagctctttttggtgatggttctggagctgtgattgtcggtgcagatcctgttgacgccgctggcgagaggccacttttcgaaatggctttcgcttctcaaactacagttccagactccgaaggtgccattaccatgcagcacacaaagggtggtatggattatcatatcggttccggtattcctgaaatgttggcaggtaacatagaaagatgtttggctgatgcctttgattctattggagttgccgctgactggaaagacctattctgggctgttcacccaggtggtagaagaatcttggatttgatcgaagaagcattaggcctagacaatggtgctatggctgcaagccgtcaagtcttgagagagttcggtaatatgtcaggtactacagtcatttttgtacttaacgaattgagaagaagattcaaggctaacggtgcagaaggagctgattggggtgccttgatggctttcggtcccggagttactattgaaaccatgttgctgagggtggctgctggtttaaagggcaattaa

SEQ ID NO: 174 - DNA, 1221 bp, Artificial Sequence
  Synthetic
atggctcctgttcccgcaacagccgctgctgccgctgctccagccgctgtcgtgtctactcatgaaattaggagagcacaaagagctgacggaccagccaccgttctagctatcggtactgctaatcctgagacttgtgtaccacaggatgaatatgcagatttctactttcgtgttaccaagagcgaacacttaccagaattgaaaaacaagctgagaagaatctgcaacaaatcgggtattgaaaagagattcatgtttgtcaatgacgacgttatggaagctcacccagaatttgctgatcgtcatcttacgagtttggatgctagagtcgagatagtttctaaggtggtcccagaattagctgccgccgcttcagcaaaggctattgccgaatggggcagacctgctaccgatatcactcacttgatattctccacatactccggtgttaaggctccaggtggtgacagattgctagcttctctattgggcttaagaccaaccgtatctcgtactgttttgtccttgcatggttgttacggaggtggtagagctttgcaacttgccaaagagttggctgaaaacaacaggggtgctagagtcttagtcgcctgtgctgaatcaacactgattgctttctatggtcccgaagttggttgtaatgacactatcattggtcaagctttgttcggagatggttctggtgccgtaatcgtcggtgctgacccagttggtgcagttgagaggccattgttcgaaatggcatttgcctcccaagctaccgtccctgatagtgaaggtgctattacgatgcaacacaaaaagggtggcatggattaccacatcggtggtggtgttccagaaatgttagccggttctatcgaaagatgtttggcagatgcttttggagcaattggtgtagccgctagatggcgtgacctattctgggccgttcatccaggtggaagacgtatcctggacttgatagaagaagctttgggtttggataacggtgcaatggctgcttccagacaagttttaagagaatacggcaacatgtcaggtacaaccgtcattttcgttttgaatgaattaagaagaagattcgttgctgacggtgcagagggtgccgactggggtgccttgatggcttttggtcccggtgtcactgtcgagactatcttacttagagtgggttctggcttgaagggtaactaa

SEQ ID NO: 175 - DNA, 1173 bp, Artificial Sequence
  Synthetic
atgccaagtttagaatcaactaagaaagccccccgttcgcatggcttcgcatccatactagctattggaagagctaaccctgagaattttgtcgaacagaacgcttatccagatcttttctttagagccaccaactccaagcacttggttaatctgaagaaaaagttccaaagaatctgtgacaaaacagcaatcaggaagagacactttgcttggaatgaagaatttattactgctaacccatgcttgcaaaccttcatggataactctttgaacgtaagacaagaatttgctattacctacatcccaaagttgggtgccgaagctgctacgaaagctatacaagaatggggtcaaccaaagtctcgtattactcatttaatcttctgtactacaagcggtatggacttacctggtgccgactaccaactgacccagatcttgggtttgaatccaaacgttgagagagtgatgctttaccaacaaggttgtttcgctggtggcaccactttgagattagctaagtgcttggccgaatctcgtaaaggtgcaagagttttggtcgtgtgtgccgaaaccactgctgttctgttcagagctccctctgaggaacatcaagatgatttggtcacacaagccctatttgctgacggtgcttcagcattgattgttggcgctgatccagatgaagctgccaatgaaagagcctccttcattattgtctctacatcgcaggtcctattaccagactccgctggtgctatcggtggacacgtcagcgaaggtggtttacttgcaacattgcacagagatgttcctcaaatcgtttctaagaatgttggtaagtgtttggaagaagcattcactccattgggtatatcagactggaactctattttttgggtaccacacccaggtggaagggccattttggatttggttgaagagagagtaggtctgaaacctgaaaagttattggtttccagacatgtcttggctgagtatggtaacatgagttcagtctgcgtgcattttgccttagatgaaatgagaaggagaagcgctaaagaaggtaaggctactaccggtgagggtcttgactggggtgttttattcggattcggtcccggtttgactgttgaaacagtcgttttgcactctgtcccaatctaa

SEQ ID NO: 176 - DNA, 1173 bp, Artificial Sequence
  Synthetic
atgccctctttagagtccgtcaagaaatcaaatagggctgatggcttcgcaagcatccttgctataggtagagccaacccagaaaactttattgaacaatcgacttacccagacttctttttccgtgttaccaactctgaacacctagtaaatttgaagaagaaattccagagaatttgcgataagacagctatcagaaaaagacattttgtgtggaacgaagagctgttgaatgccaacccttgtttaggtacttttatggacaatagtttgaacgtcagacaagaatttgctattcgtgaaattccaaagttgggtgctgaagccgctaccaaggcaatccaagaatggggtcaaccaaagtccagaatcacccacttgattttctgtacgacttctggaatggacctaccaggtgctgattatcaattgactcaaatattgggtttaaacccaaacatcgaaagagttatgttataccagcaaggttgtttcgccggtggcaccacattgagactggctaaatgtttggctgaaagtaggaagggagcaagagttttggttgtctgcgctgagactacagcagttctattcagagctcctagcgaagaacatcaagacgatctagtgactcaagctctgtttgccgatggtgcttctgccttaattgtcggtgccgacccagacgaaaccgctcatgaacgtgcttccttcgttattgtttctacctcacaagtcttgttgcctgattctgctggtgcaatcggtggtcacgtcagcgagggtggtttgatcgctacacttcacagagatgttccacaaatagtttccaagaacgtcggaaagtgtcttgaagaagctttcactcctttaggtattagtgattggaatagtatattctgggtcccccatccaggcggcagagccatcttggatcaagttgaagaaagagtgggtttgaaaccagaaaaattgattgtatccagacacgtgttggctgagtatggtaacatgtcttctgtttgtgttcactttgctttggacgaaatgagaaagaggtctaagaaagaaggtaaggctactaccggtgagggtttagactggggtgttctgttcggttttggtccaggtttaactgtcgaaacggttgttttgcattcggtaccaatttaa

SEQ ID NO: 177 - DNA, 1191 bp, Artificial Sequence
  Synthetic
atgggcagtgctccagcaactgtcggtgaaatccgtagagctcaaagagccgacggtcccgccgctgttttaggaattggtacagctaaccctccaacgtgtgtggctcaggatgactatccagattactacttcagagtaacttcgtcagagcatctaaccgatttgaaagctaagttgaccaggatatgcaagaagtccggtattaaacaaagatttatgcacctgaatgaagaacttttggcagccaacccagacttcactgatagagctttgcctagcttagacgccagagtcgatatcgcatctgctgctgttccagaattggctgcctccgctgctgctaaggctattgccgagtggggtaggccagcaactgaaatcacccacctgatcttttctacatactctggtgccagagctccatccgctgacagacgtttggcttcattattgggtttatctccaactgtctcgagaaccatgcttaatttgcatggatgttatggtggtggccgttctttgcaactagctaaggaattggcagaaaacaacagaggtgccagagttctagttgcttgttctgaaattactcttattgctttctacggtccagaaggtggttgtccagataatatcttgggacaagccctatttggtgacggtgctggtgctgttattataggtgccgatcctgttagtcccgtcgaaagacctttgttcgaaatggcattcgcttcccaaactaccataccagagacagaagacgcaatctccatggagattactaaaggcggcatggaatatcacatttctaaccaggtgccaagactgcttggttctaacgttgaaagatgcttgattgatgcttttgacgccttaggtgtctccgctaagtggaacgatttattctgggctatccatcctggtggtagagccattttggaccacatcgaaggtgtcttgggtttagatgatggtaagttggctgcttctcgtcacgttttgagtcaatttggtaatatgtctggcaccacggtcattttcgtgttagacgaattgcgtagaagaagagcagccaagcaagaaggtgaagctcctgaagagtggggtgttgtcatggctttcggtccaggtatcactatagaaaccatggttttgcatgccccaagcaatctgggtggtaactaa

SEQ ID NO: 178 - DNA, 1206 bp, Artificial Sequence
  Synthetic
atggcacctgtcccagctactgctgccgctggtagttccacacgtgaaataaggagagcccaaagagcagacggcccagctgctgtattagctattggtaccgctaacccagagaaatgtgtgactcaggatgaatacgccgatttctattttagaatcaccaattcagaccacctacccgaactgaaggataagctttctcgtatctgcaacaagtcgggtattgaaaaaagattcatgtacgttagcgacgaattgatggaagctcatccagagtttgctgatagacacttgccttctttggatgctagagtcgaaatcgcctccaagaatgttccagaattggcagccgctgcttccgctaaggccattgctgagtggggaagaccagctacggacattactcatttaattttctctacttactctggtgttaaagccccaagcggtgacaggttgttagcttcattgctaggtttgcgtccaacagtctctaggaccgttctttcgttgcacggttgttatggtggtggtagagctctgcaacttgccaaggaattggcagaaaacaacagaggcgcaagagttttggtcgcttgtgctgaatccactttaatcgcattttacggtccagaagtcggttgtaacgatatcatcgttggtcaagccttgttcggtgacggcagtggtgctgtaattgttggagctgatcctgtggacgctgttgagcgtcctttatttgaaatggccttcgcttctcaaaccaccataccagattccgagggtgccatcaccatgcaatatatgaagggtggtatggactaccatattgcttctggcgtacccgaaatgttggctggtaatgtcgaaagatgtttggctcacgccttcgactctgttggtgttgcagctaaatggaaggatttgttttgggccgtccaccccggtggtagaagaattttagatctaatagaagaagctttaggcttggaaaacggtgcaatggctgcctcaagacaggtcttaagcgaatttggtaacatgtcgggaactaccgttatattcgttttaaatgagttgagaagaagattcgaagctgatggtgccgaaggtgctgactggggtgctctaatggctttcggtccaggagtcactgtcgaaacggtcctattgagagtggctagtggtcttaaaccaaatcaataa

SEQ ID NO: 179 - DNA, 1197 bp, Artificial Sequence
  Synthetic
atgccagcctcacgttgtgcatccaaccccctggtagctccaggattgttcattgtgggtctaggttctcagtaccctccatatcttttagaccatgagaaattgacctgctttgctggtagattccacgatatcaggcgtccaggcttgcaaaagttgctacaaataaatgctagtacgggtattgaaacaagatctagcatcagatcgtacgaaactggctttgcttgtgaccctgttccaccaagtattgccgatttagacgaattgttcagaagagatggtgttgatttggctgttcaagcttgtatgaaggccatgaaggaagctggtgtcttacctgagcaaatcacccacactgtctccgtcacttgcaccaaccaaggtaacccaggttatgacttgcttgttaatgaacgtttgggtttgccagaaagaacttctaggatcttactacatggtgttggttgtgcaggaggtttgtccattatgagagttgcttctcaggtcgcctgtggtgctacaatgagaggaagaaaagcttgtatattagtttacgcatgtgaattgtgcaccccaaatgtaagacacgacctggccgaagctgagcaatgtactgatttgagcaaggtgaacattgctggtgccctgttctctgatgctgccgctgcatttatcttgtgtaacaagaccgctttagaagaatcatccgcctctccaattttcgaattgatcgaatgggataatgctctaatacccgacaccatgcaacacctgacttgttacaccgatccttatggtttcagatctgtcttgactaaggacattccaacgtacgctaagggtgctattggtcctatgtttcataaattgcttccctcctacgaagaacaagttttggctgccgacatccaccttggcatcgacgatttcgattgggcagtgcatccaggtggtaaagctttgattgatggtgtccaagaaactatgcagttaactgaagaccaacttcaagcctcccgtgaaatttatagaactagaggtaacagctcatccccaacaattttgtctgttttggatcgtttaagaacttacgagaagcaaaggggtcatgttgttgctgcatcgttcggcccaggtatggctatcgaaatggtcatgttgaaaagatgtgaagtcgctggtggtggccaataa

SEQ ID NO: 180 - DNA, 1197 bp, Artificial Sequence
  Synthetic
atgccagccagtatatgtgcaaattcgcctcttgtcgctccaggtttatttattgttggactaggttctcagtatcccccatacttgttggatcatgaaaaattgacatgcttcgctggccgtttctacgacatcaggcgtccaggtttacaaaagctgttacaaattaacgctagcactggtatcgagactagatcctccattagatcatacgaaaccggttttgcttgtggtcctgtaccaccatctatagccgatttggacgaattgttcagaagagatggtgttgacctagctgtccaagcctgtatgaaggctatgaaggaagcaggagttttgccagagcaaatcacccacacggtcagtgttacttgcaccaaccaaggtaatcctggttatgacttgcttgtgaacgaaagactgggtttgccagaaagaacttctaggattttattgcacggtgttggttgtgctggtggtttgtctattatgagagttgcttcgcaagtggcttgtggcgccacaatgagaggtaaacccgcttgtatcctagcttacgcctgcgaattatgtaccccaaacgtcaggcatgatttggctgaagccgaacagtgtactgacttgtctaaggtaaacatcgccggtgctcttttctccgatgcagctgccgcttttattttatgtaataagactgcactagaagaagttaatgcttcaccaatattcgagttgatcgaatgggataacgctttaattccacacaccatgcaaaacttgacgtgttataccgatccttacggttttagaagcgtcttgtctaaagacatccctatgtatgcaaagggtgctattggcccaatgttccataagcttttgccactatacgaagaacaagtctccgctgttgataaacacctatctatcgatgacttcgactgggccgttcacccaggaggtaaggctttgattgatggtgtacaagaaacaatgcagttaactgaggaccaattgagagccagtagagaaatctacaagactcgtggtaactccagttcacccaccattttgtccgtcttagatagactgagaacgtacgaaaagaatcgtggacacgtcgttgctgcttctttcggtccaggtatggttattgaaatggtaatgttgaagagatgcgagagaaactttccaactgcctaa

SEQ ID NO: 181 - DNA, 1197 bp, Artificial Sequence
  Synthetic
atgccagcatctcgttgcgctagcaatcccttagtcgccccaggattgtttattgtaggtctaggttcccagtatcctccatacttgcttgaccatgagaagctgacgtgtttcgctggtagattccacgatataagaagacctggcttgcaaaaattgttacaaatcaacgctagtaccggtattgaaactaggtcatcgatcagatcttacgaaactggttttgcctgtgatccagttccaccatctattgctgacttggatgaactgttccgtagagatggtgtcgacttagctgttcaagcatgtatgaaggctatgaaggaagccggcgtgttgccagaacaaatcacacacaccgtttccgtcacctgtactaaccaaggtaatcccggatacgacctattggttaacgaaagattgggtcttccagagagaacttctaggatcttgttacatggtgtaggttgtgctggtggtctttccataatgagagttgctagccaagtcgcttgcggtgccacaatgagaggtagaaaagcttgtattttagtttatgcttgcgaattgtgtacccctaacgttagacacgatttggccgaagcagaacagtgtactgacttgagcaaggtcaatattgctggtgctctattttctgacgctgccgctgctttcattttatgcaacaagaccgcattggaagagtcttccgcttcaccaatcttcgaattaatcgaatgggataacgctttgattccagatactatgcaacacttaacctgttacactgatccctatggctttcgttctgttttgactaaggacattccaacgtacgctaaaggtgccataggtccaatgttccataaacttttgcctagttacgaggaacaagttctggcagccgacattcacttgggtatcgatgattttgattgggccgtccatccaggaggcaaggctttgatcgacggtgtgcaagaaacaatgcagctaaccgaagaccaattacaagcttccagagaaatatatagaacaaggggaaattcttccagtccaaccatattgtctgtgttggatagattaagaacttacgaaaagcaaagaggtcacgtcgttgctgcttcgttcggtccaggcatggccattgaaatggtcatgttgaagagatgtgaagttgcaggcggtggtcaataa

SEQ ID NO: 182 - DNA, 1197 bp, Artificial Sequence
  Synthetic
atgcctgcctcgaaatgcgcaaattcaccattagttgctcccggactttttatcgtcagtctaggtagccaatatccaccttacttgctgaaccacgaaaagttgacttgtttcgctgagagattctacgacatacgtagaccaggcttgagaaagttattgcagattaacgcttctaccggtatcgaaacaaggtcttccattagatgttatgaaactggttttgcctgtgattccgtaccaccatctattgctgatttagacgaattgttcagaagagatggtgttgacttgaccgtccaagcttgtatgaaagccatgaaggaggctggtgttctaccagaacaaatcacgcatactgtcggtgttacctgtactaatcaaggtaacccaggttacgaccttttggtgaacgaaaagttgggcttgcctgaacgtacctctcgtattcttttgcacggtgttggttgcgctggaggtctaagcataatgagagtcgcttcacaagtcgcttgtggtgaaacaatgagaaagcgtccagcatgcattctggcatacgcttgtgagttatgtactccaaacgttagacatgatttggccgaagctgaacaatgcaccgatttatccaaggttaatatcgcaggcgctttgttctctgatgccgctgctgcttttattttgtgtaacaggactgctttggaaggtatcaatgctagtcctatattcgaattgatcgagtgggactatgccttgattccagacactatgcaacacttaacatcttacaccgatccctatggttttagatctgttttaaccaaagacataccaacttacgccagagccgctattggtccaatgttccatagacttctaccatcctatgaagaacaggtttttgccgctgatatgcaattgggtgtcgtaaacttcgattgggccgtccaccccggcggaaaggctctgatcgacggtattcaagaaacgatgcaattgacagaagatcaattaagagcatcgagagaaatctacaggactagaggtaacagctctagtccaaccatcttgtccgtcttagacagattgcgtacctacgaaaagaagagaggtcacgttgttgctgcctctttcggacctggtatggctattgaaatggtgatgctgaaaagatgtgaagttgctggtggtgaaagataa

SEQ ID NO: 183 - DNA, 1170 bp, Artificial Sequence
  Synthetic
atgttgcaggagactagaccaggcgtagctacaattcttgccatcggtaccgctaaccctccagactgcttttgtcaatctgaatatcccgatttctacttccaactgactaattcacaacatatgacgcaattaaaacaaaagtttcagcgtatatgtgaaaggtcggcaattcaaaagagatacatgcacttgagcgaagacatgatcaaagaaaacccaaatctatccatctatagagctcctagtttagatgtcagacaagagattttgattaccgaagttccaaagttgggtaaggaagctgccttgaaggctatcaaagaatggggacaaccattgtccaacataactcacttaattttctgtacttcttgttgtgctaccgcaccaacagctgattaccattttgccaacttaattggtctgaagccatctatccaaaaattctttatctacggtcaaggttgctatgcagccggtaccgctttgcgtttgagtaaggacttggtggaaaacaatgttgattcaagagtcttgatagtttgttccgaattaatgctgggttgtttccacgctccttctgaaactcatcttgatattttggttggttccgccattttctctgacggcgctgctgctctaatcgtaggtgcaaatcccgacaccaacaagaatgaaagaccattgtttgagatcatttctgctaaccaaactgtcatcccagactccgaaactatgatgcacggtaaaatttgtgaaatgggtatcaattactatattagtaaggaattaccaaagtacatagctaacaacatcgagcagtgcttgatcgaaatgttcacccctttcggtattaacgattggaatacgttgttttacgcagttcacaacggaggtccagctgttctaagaggtattgaagaaaagttaggattggataaagataagctggaggcctcttggcatgttttgagagaatacggtaacatgtggagcccatctgtcctatttgcccttgacaagatgagaaaaatgtccataaagcaaggtaagtccacaacgggtcaaggtttggaatggggtgtcttgcttgcattgggcccaggtttgactgtggaaaccgttggtttgaggtcttgcgctgtggtcggatacgcttgtatctaa

SEQ ID NO: 184 - DNA, 1176 bp, Artificial Sequence
  Synthetic
atgccatacatcatagaaaccgccactggtttccctgagcactattacccacaggaagtcctagaagtaaacattagaaatcattgtgcaaacttacttcaagactattgcttgcgtaatcacctggattttcaagaacaaacgttctttgatttagaacaaattcatagattcttcagcaacgtgaagatccaaggaagatactttactatccccttggacgaatttgatgttgacaacccaccaggtattgctcaaccattcaggcaaatggtcgatttgacaatggatttggttaccagtactgttaccaatttgcttaaaaaggctgctttatcaccaaaagaaatatccttggttacttctgtcaccgttttaccttctgttccatccttggagtctctattgctgaacagattggacttctcgttggatatcaagagacaggccctttctggtgtcggctgtctaggtggtgctcaaggtttagctagagtgaacgactacttgcaaggtcaccctacggaagccgctattttgttcactaccgacccatcctcaggtttgtggcaaggctctattcatagtgatttgactgagttattgggtcaattgccagaagacccatcccagtattctaacattatcatgacgctagttgtcgccgctttatttggtgatggagttggtaccgtactgttggctggtgacgaacaccccttggtgaagcaaggtaaggcaaaattaaagatcataggtacacagagtttgttaatgcctcatacagagcacttaatggcactgccattgactgactacggattccgtcaaattctaagaccagaagtctccgattatgttaagggtggtgttagaaaagctgttacttctctactggaaaagaccggtgtctcattggaagaaatcgtgtgttggatggttcacccaggcggtccaaagattttggatgctattgtcgaagaatttcaattggagcccgatgtgctgcaagtttcttgggatattcttgccgaaatcggcaatatcgcctccgctaccattttgtgtatacttgacgaaactcttagccgtccacacccacctactggctcttacggtttgattatctcaatgggtcctggttttgctcaagaagctatcttggtccaattctaa

SEQ ID NO: 185 - DNA, 1212 bp, Artificial Sequence
  Synthetic
atgggttcccaaggagaatactataacaaggagggtagaggtcaggctgcaattctgggtataggcagcgccgtcccaccctacgaattgcctcaatcatcgtttccagattactatttcgacgtttctaattccaaccatcgtcaagatttaaaagctaagttcgctaagatctgtgaaagaacaatgattgaaaaaaggtgcgtatacatgtctgaagagtttctaagatccaacccatctgtgactgcctactcttcaccaagcatcgacgtcagacaaagacttaccgatgctacggttcctgaattgggtgctgccgctgctcgtgttgccattgctgactggggtagaccagcatctgaaatcagtcacttagtcatgtgttcgaccgtatctggttgtatgccaggtgctgactatgaagttgttaagttgttgggtttacctttgtccactaagagatgcatgatgtaccacattggctgtcatggtggaggtactgtcttgagaatcgctaaagatattgccgaaaataacccaggtgctagggtgttagttgtctgttcagaggttatttccatggcactaagaggaccaagtgattctaatatgggtaacttggttggtcaagctctgttcggtgacgcaggcgctgccgtcgttgtgggtaccgatccagttgaatcttgtggtgaaagagctttattcgaaatggttgctgccatgcaagacataatccccgacactgaggaaatggttgtcgctaagcttcgtgaagatggtttgttgtacagtttgcatagagatgtcccagtccacatcgaagctaacatagaagcaattgtgaacaagtctggtgttggtgccaaagctgccgattggaatgaagacgttttttggttggtccacccaggtggaagagatattttagatagagtggctcgtagattgggtctaagacatgacaaggtcgaggtttccagagaagtaatgagaaagcacggtaataccttgtcatcttgtgttgttatcgctatggaagagatgaggagaaggtcggccgaaagaggtatgggtacagctggtgaaggcttggaatggggtttattatttggtttcggtcctggtctgactgtagaaaccatcttgttaagagctcctcttacacacccaccaccatgtgcccatgctgctgtccgtcctcaataa

SEQ ID NO: 186 - DNA, 1191 bp, Artificial Sequence
  Synthetic
atggcttcctctattgagaatatgtcacaagaaacccgtcagggcgtcgccacgatcttggctataggtactgcaaacccacctaactgcttttgtcaatctgaataccccgatttctatttccaactaacaaatagccaacacatgacccaattgaaacagaagtttcaaagaatttgtgaaagatcggctatccaaaagaggtacatgcatctgtccgaagacatgattaagggtaacccaaacttgtctatctatagagctccaagtcttgatgttagacaagaaatcttaattactgaagtgccaaaattaggtaaggaagccgctttgaaggctataaaggagtggggacaacctttatccaacattacacacttgattttctgtacctcttgctgtgccactgccccaactgctgactaccattttgcaaatctgattggtttgaaacacagtatacagaagttctttatctatggtcaaggttgttacgctgctggtactgctttgagattatctaaagatttggttgaaaacaacgttgacagccgtgtccttatcgtctgttcagagttgatgttgtcctgtttccacgcaccttctgaaacccatttggacattctagttggatccgctatcttctcagatggtgcagctgccttaatagtaggcgctaatcttgatacgaataagaacgaaagaccactattcgaaattatcagcgccaatcaaactgttattccagattctgaaactatgatgcatggtaaaatatgcgaaatgggtatcaactactacatttctaaggagctaccaaagtgtatcgccaacaacattgaacaatgcttgattgaaatgtttacaccattcggtatcaacgactggaataccttgttctacgttgtgcacaatggtggtcctaccattctgagaggtattgaggaaaaattaggacttgataaggacaagttggaagcttcatggcatgtcctgagagaatatggcaacatgtggagtccatccgtgttgttcgctttggacgaaatgcgtaaaatgagtatcaagcaaggtaaatcaactactggtcaaggtttggagtggggtgttttgttggctttaggtcccggtttaaccgtagaaactatcggtttgagatcttgtgtcgttgcaggatacgcttctgaataa

SEQ ID NO: 187 - DNA, 1191 bp, Artificial Sequence
  Synthetic
atggtaatggcagctggtgcctcttccttagatgaaattaggaaagctcaacgtgctaacggaccagccggcatactagctatcggtactgccaatcctgagaaccacgttcttcaggctgaataccccgactattactttagaatcacaaattcagaacatatgaccgatttgaaggaaaagttcaagagaatgtgcgacaaaagcatgattagaagaagacacatgcatttgacggaggacttcttgaaggaaaacccacacatgtgtgcttatatggctccatcgctggatacccgtcaagatatcgtcgttgtcgaagtgccaaagttgggtaaagaagcagctgttaaggctattaaggaatggggtcaaccaaaatctaagattactcacgtcgttttttgtactacctccggtgttgacatgcctggtgccgattaccaattaactaagttgctaggtttgaggccaagtgttaaaagacttatgatgtaccaacaaggatgtttcgcaggcggtaccgtgttgagaattgctaaggacttagcagaaaataacagaggtgctagagtcttggttgtttgttctgagatcacagctgtcactttcagaggtccatctgatactcatttagattccttggttggtcaagccctattttctgacggcgctgccgctttgattgtgggttcagatcctgacacatcggtcggtgaaaagccaatcttcgaaatggtaagcgccgctcagaccatcctgccagattctgatggtgcaattgacggtcacttgagagaagttggtcttacctttcatttattgaaggacgtcccaggtttgatctccaaaaacatagtgaaatcccttgatgaagctttcaagcctttaggtatttctgactggaactctctgttctggatagcccatccaggaggtcctgctatcttggaccaagttgaaattaaattgggtttgaaggaagaaaagatgcgtgctactagacacgtactatcagagtatggtaatatgtccagtgcatgtgttctgtttattttggacgaaatgagaaggaaatctgctaaggatggtgtcgctactacaggtgaaggtcttgagtggggtgtcttgttcggtttcggccccggtttgacggtcgaaaccgtcgttttacacagtgttccactataa

SEQ ID NO: 188 - DNA, 1191 bp, Artificial Sequence
  Synthetic
atgtcaactacaatcaccgttttaacggacacttggtcccatcgtgccaaaaggctagagggtgatgctaagattcttgctataggaaccgcaactcctgccaattgggtggatcaaaccacttatccagacttctactttagaattacaaactctgaacacttgttggaacacaaggaaaagttcaaaagaatctgcaacaagagtaaaattatgaagagacacttggtaattaccgaagaattattgaagaaaaatccaaacttgtgtacctacaatgaggcttctttgaacactagacaggatatcctagtcagcgaagtccccaagctgggtaaggaagcagctatgaaggccatcaaagaatggggtagaccaatctctgagattacgcatttagttttttgtactacttcgggtgttgacatgccaggcgctgatttccaattgactaagcttttgggtttaaactcctccgttaagagattgatgatgtatcaacaaggttgtaacgctggtgctgctatgctaagattggccaaggacttagctgaaaataataaaggcgctcgtgtcctagttgtctgttctgaagtgatgttgtcagtatttagaggtccttcgcttcagcaagaagacaacttgcttgctcaatgcttgttcggtgatggtagtgccgcagttatagttggtaccgaaccaagaccaggattggaaacaccattattcgaattggtcagtgctgcccaaaccacgattccagatacggactttcatctaaaattgcacttgagagaaatgggtcttactttccattgttctaaggctgttccatctttaattactcaaaatgttgaagattgtttggtaaaagcattcgaaccttttggtatcagcgattggaactccattttttggatcttacaccccggtggtaacgctatattggatggagtcgaagagaagctaggtttggagccagaaaagctgcgtgcctcaagagatgtcctatcccaatacggtaacttgacctctgcttgcgttttgttcattttggatgaagtgcgtaagaagtcaaagaaacaacaacaaatgacaactggcgaaggtttagagtggggtgttgtcttcggttttggtcctggattaaccatagacacgatcgttattagatctgtcccaattaattaa

SEQ ID NO: 189 - DNA, 1173 bp, Artificial Sequence
  Synthetic
atgaccgtagaagaggtgaggaaagctcaaagagcagaaggtccagccactgttctagctattggaacggctactcctgccaattgcgtctatcaggctgactacccagattactactttaagataacaaagtcagaccatatggctgatttgaaagaaaagttcaagcgtatgtgtgacaagtcccaaatcagaaaaagatatatgcacttaaccgaagaaatcctgcaagataaccccaacatgtgtgcctacatggctccaagcttggacgcaagacaagatattgttgtcgttgaagtcccaaagttgggtaaggctgccgctcaaaaggctattaaagaatggggtcaacctagatcgaagatcactcacttagttttctgtacaaccagtggtgtggatatgccaggcgccgactaccagttgactaaaatgcttggtttgcgtccatctgttaagagattgatgatgtatcaacaaggttgttttgctggcggtactgttctacgtttagcaaaagaccttgctgagaacaatagaggtgctagagtcttagttgtctgctctgaaattaccgccgtaacattcagaggtccacatgaatctcacttggattccttggttggtcaagctttgtttggtgatggtgctgctgctgtaatcgttggtgccgaccccgatatgtctgtcgagcgtccattgttcgaattagtctccgctagtcaaactatattacctgacagcgaaggtgccattgacggacatctaagagaagtcggattgaccttccacttgctgaaggatgttccaggtttgatttcaaaaaacattgagagagctctggaagatgcttttaagcctttgggtatcgatgattggaatagtgttttctggatcgcccatccaggtggcccagctattttggacatggtcgaagctaaggtaaaccttaacaaggaacgtatgagggctacgagacacgttctatctgaatacggcaacatgagctctgcatgtgtccttttcataatggacgagatgaggaagagaagcgcagaagacggtcacactacaactggtgaaggtatggattggggtgttttgttcggttttggtccaggtttaaccgttgaaacggttgtgttgcactccgtgccaatcaccatataa

SEQ ID NO: 190 - DNA, 1170 bp, Artificial Sequence
  Synthetic
atggtttccgtagaggaaattagacgtgctcaaagagccgatggcccagcaactatactagctatcggtacaagcacccctccctactgtgtcgaacagagtacttatccaggttactacttcaggattacgaaatcggaacataagaccgaattgaaggacaagtttaagagaatctgcgaaaaatcttgtgtgaagagaagatatatgtaccttactgaggaagtcttgaaagaaaacccaaatatgtgtgctcacatggctccatctttagatgcaagacaagacatggccattgttgacgttcctaagctgggaaaagaagctgctgctaaggctatcaaggagtgggatcaaccaaagtctaagatcacccacttaattttccatactacctccggtgccgaaatgccaggtgcagattatcaattgaccaagttgttaggtttgcgtccctcagtcaagagatttatgatgtaccaacagggttgcttcgctggtggtactgttataagaatggccaaagacttggccgaaaacaacagaggagccagagttcttgttgtctgttccgaaattacagctgttactttccgtggtccatctgaaacaaatccagacggtctagtgggtcaagctttgtttggcgatggtgctgctgctattatcatcggagcagatcctataccagaggtcgaaaagccattgttccaactggtaaccgccggtcaaagcattttacctgacagtgatggcgctatttctggtcaacttagagaagccggtttgactttgcacttggttagagaagtccctaacctgatcgctaaaaatattgaagattcattgatcgaagcttttgagccattaggtatttccgattggaactccatcttctggatcgcacacccaggtggtcctgccattttagacaagatcgaagctaagttggctttgaaaccagaaaggctgcgtgctaccagacatgttttgagtgagtatggaaatttgtcctctgcatctgtcttatttatcttggatgaaatgagaaaaagttctcgtgaaaagggattctctactacaggtgaaggtttggactggggtgttttgttcggtttcggcccaggtctaactgttgagtcagtcgtattacactctgttccagcttaa

SEQ ID NO: 191 - DNA, 1191 bp, Artificial Sequence
  Synthetic
atgtccactaccataacagtcttgactgatacctggagtcacagggcaaagagactagaaggagatgctaaaatcttagccattggcacggctactccagctaattgggttgaccagaccacttaccctgacttttatttcagaatcaccaactctcaacatctgcttgagcacaaggaaaagttcaaaagaatttgcaacaagagcaagatcatgaaacgtcatttgttgattacggaagaattgttaaagaaaaatccaaacttgtgtacatacaacgaggcctcactgaacactagacaagatattctagtgtccgaagttcccaagttaggtaaggacgctgctatgaaagccatcaaggaatggggtagaccaatatcggaaattactcacttggtcttttgtaccacctctggtgttgatatgccaggtgctgacttccaattgactaagttgttgggtttgaatagtagcgtaaagagattaatgatgtatcaacaaggttgtaatgcaggcgctgcaatgttgcgtctagctaaggatttggctgaaaacaacaaaggtgccagagtcctagttgtctgctccgaagttatgttatcagtatttagaggtccatctctacaacaggaagacaatctattggctcaatgtttgttcggtgacggttccgccgctgttatcgtgggtactgagcctcgtccaggactggaaacaccattgttcgaattagtctctgctgctcaaaccacaatacccgatactgattcttacttgaagctgcaacttagagaaatgggtttaacatttcactgttctaaagccgttccaagcttgatcactcagaacattgaggactgtttggttaaggccttcgaaccctttggcatttctgattggaatagcattttctggatcttgcatcctggtggtaacgctatactggacggtgtagaagaaaagttgggtttagagccagaaaaattgagggcctctagggatgttttatcgcaatacggtaacttgacctctgcttgcgtcttatttattcttgatgaagtgagaaagaagtccaaaaagcaacaacaaatgactacaggagaaggtttggaatggggtgtcgtcttcggattcggtccaggtttaaccatcgacactgttgtaatcagatccgttccaatcaactaa

SEQ ID NO: 192 - DNA, 1197 bp, Artificial Sequence
  Synthetic
atgccagcatctcgttgtgcctccaatcccctggtcgctcctggactattcattgttggtttgggctcacagtatccaccatacttgttagaccacgaaaagttgacatgctttgctggtagattccatgatataagaaggccaggtttgcaaaaacttttacaaatcaacgctagcactggtatcgagactagaagttccattagatcttacgaaaccggttttgcctgtgatccagtacctccatcgattgctgacttggacgaattattcagaagagatggtgtggatttggctgtccaagcctgtatgaaggctatgaaggaagctggtgttctacctgaacaaatcacccacacggtttctgtcacttgtaccaaccaaggtaatccaggctatgacttgctggttaacgagcgtcttggtttgccagaaagaacttctaggatattgttacatggtgttggttgcgccggaggtttgtcaattatgagagtagcttcccaagtcgcttgtggtgctacaatgagaggcagaaaagcctgtatccttgtctacgcatgcgaattgtgtaccccaaatgttagacacgatctagcagaagctgaacagtgtactgacctgtccaaggttaacattgctggagccttgttcagcgatgccgctgctgcttttattttgtgtaacaagactgccttagaagaatcctctgcttctccaatcttcgaattgattgagtgggacaatgctttgatccccgatactatgcaacatttgacctgctacaccgatccatacggttttagatcggtccttactaaagacatccctacgtatgctaagggtgctatcggtcctatgttccacaagctgttaccatcttatgaagaacaagtgcttgctgctgatattcacttgggtattgatgacttcgactgggcagttcacccaggtggcaaagcattaatagatggtgttcaagaaacaatgcaattgaccgaagaccagttgcaggcatcaagagagatataccgtaccaggggtaactcttccagtcccactattttgtctgttttagataggttaagaacatacgagaagcaaagaggtcatgttgtcgctgctagttttggtccaggtatggccatagaaatggtgatgttaaagcgttgtgaagtcgctggcggtggccaataa

SEQ ID NO: 193 - DNA, 1197 bp, Artificial Sequence
  Synthetic
atgcctgcttccagatgcgcatcaaaccccctagttgccccaggccttttcatcgtaggattaggtagtcaatatccaccatacttgctggaccatgagaaattgacttgttttgctggtaggttccacgatataagacgtccaggtttacagaagttgttgcaaattaatgcttctaccggtatcgaaacaagaagctctattagatcatacgaaacgggttttgcctgtgatcctgtgccaccatctattgctgacttggatgaattattcagaagagatggtgttgacttggctgtccaagcctgtatgaaggctatgaaggaagctggtgttttacccgaacaaatcacccacactgtctccgtcacttgtactaaccaaggtaaccctggttatgatttgcttgttaatgaaagattgggactaccagaacgtacctctaggatcttgcttcatggtgtgggttgcgctggcggtttgtcgataatgagagttgcatcccaagtcgcctgtggtgctaccatgagaggtagaaaagcatgtatcttggtttacgcttgtgagttatgtaccccaaacgttcgtcacgacttggctgaagctgaacaatgcactgacttgagtaaggtaaatattgccggagctttattctcagatgccgctgctgcctttatcctatgtaacaaaactgctttggaggaatcctctgcttctccaattttcgaacttattgaatgggataacgctttaattcctgacacaatgcaacatttgacatgttacactgacccatatggtttcagaagcgtcctaacaaaggacatcccaacctacgccaagggtgcaattggcccaatgtttcacaagttgttgccttcttatgaagaacaggttcttgctgctgatatccacctgggtatcgatgattttgattgggctgtgcacccaggtggtaaggccttgattgacggtgttcaagaaacgatgcaattaacggaagaccagttacaagctagtagagagatttacagaaccagaggcaattcctcgagcccaactatactatctgtcttagatagattaagaacatacgaaaaacaaaggggacatgttgttgccgcctctttcggtccaggtatggcaatcgagatggttatgttgaaaagatgtgaagtcgctggtggtggtcaataa

SEQ ID NO: 194 - DNA, 1209 bp, Artificial Sequence
  Synthetic
atggcacctttattgcatggtaccccacccccagagctaaggatccacaatgatgttccattgtccaaaagagtcgtgtctgttgtaggcacaggtgctcactacccaagctatgaatttccatctgacgaacttgaaaagttgataagtgctgcccatgatcctaacgacccagctattagaaagactttacacatcaacgaaaaatcaagaatccaataccgttatactgccgtcccattagatgacccatactggtcgggtcccaagctgcctgatgttgccggatgtgatgctttgttcagaaagtacggtgtcccagttgctgaggaagctgcccgtaaggctttggcagactggaatggttccttgaacgatattacgcatattgttgttgtcacctgtacaaacaccgctaatccaggtcttgactatatgatttgcgaaagattaggtttgcacaaaaacgtccagagaactctactgcacggtgttggttgtgctggtggtgtatctgctttgagaactgccaacgaattgttgctaggcgctgcattccaaggtaggccaggtagagcattggtggtggcatgtgaaatatgcaccatctttttcagatctatgctggaggatattgttaagacccaagaagccaatgttgctatggctttgtttggcgacggtgcttcggctatggtcctatctaatggaatcggtccagaaactttcgaaagagctccattgtggaacatcttgaactccagaactaccttactagaagacagtttatcttcccttcaattcaacattcatcctaacggttacaatccagttatcaccaaggatgtccccggtcaaacttcagccgctttgccatcgggtttccacgatttgattgcttctacaccttccttgtgttctgataaaagtaactttgacccatcatcttacgattgggcattgcatcctggtggttatagtattgctgttttagcccaaagcgctctgggaattactgaacaccatttgagaaagacttacgacgtttatcgtttaagaggtaacacctcctctagcacagttatttctgtcataaatgaattggctaaggagcaggacactccagaatccggtagaggtaaggtcatcgtcgccgcctttggcccaggtataactatggaaatggctgtaatggctagaccagcctaa

SEQ ID NO: 195 - DNA, 1188 bp, Artificial Sequence
  Synthetic
atgggttccgctccagccaccgtcggagaaatcagacgtgcacagagagctgacggccctgctgccgttctgggtataggtactgctaatcccccaacgtgtatggctcaagatgattatccagactactacttcagggtaactaactcagagcatttgaccgatctaaaagccaagttgacaagaatttgcaagaagtctggtattaaacaaagatttatgcacttaaacgaagaattgttagctgccaatccagacttcacagacagaaagttgccatcgcttgatgctagagtggatatcgcttctgctgccgtccctgaattggcagctagtgctgccgctaaggcaatcgctgaatggggtagaccagctaccgagattactcacttgatcttttctacttattccggtgctcgtgcacctagtgctgacagacgtttagccagcttgcttggtttgtctccaaccgtttcaagaactattctaaacttgcatggttgttacggcggaggtagatctttacaactagctaaagaattggctgaaaacaacagaggtgctcgtgttctagttgcctgttccgaaattactttgatagctttctacggtccagaaggtggttgcccagataatatcttaggtcaagctctgtttggtgatggtgccggtgcagtcattattggcgctgaccctgtgagcccagttgaaagacccttgttcgaaatggctttcgcttcccaaactacaatccctgaaaccgaggatgcaatctctatggagataaacaagggcggaatggaataccacatttccaaccaagttccaagattgttgggttgtaatgtcgaaagatgtttgattgacgcatttgatgccctgggtgtaacggctaaatggaacgatctgttctgggcaatacatccaggtggtagggccatcttagaccacattgaaggagtcttgggtttggacgatggtaagctggctgcttctcgtcatgttctttcagaatttggtaacatgtctggaaccactgttattttcgttttggatgagttaagaagaagacaagctgctaagcaagaaggtgaaactccagaatggggtgtcatgatggccttcggccctggtatcacgattgaaactatggtcttacacgccccaggtagcttggatgcctattaa

SEQ ID NO: 196 - DNA, 1296 bp, Artificial Sequence
  Synthetic
atggcctccctatgccatattcctttccaaaagcagatgagcaattgtcgtactgttcacccaatctttggacaaaaatctaggttgttaataaagaacttggctaaatcattcgtcccagcaaagacggctaccgttgaagagattagaagagctcaaagagccgaaggtcccgcaacagtgcttgctatcggcactgctaccccaagtaactgtttttatcaatgtacttacccagactacttcttcagagttaccaactctgaacacaagactaaattgaaggaaaagtttaaaagaatgtgtgatggttctatgatcaaaaagagatatttacatttgactgaggaaattctgaagaagaatccaaacatttgcgaatacaaggcttcgtctttcgacgccaggcaagaaatcgctattgtagaagtccctaagttgggtcaagaggccgctgaaaaggctatcaaagaatggggtcagtcaaaatccaagatcacacacctagttttctgtaccacaactagcgtcgaaattccaggtgcagattaccaattgaccaaactgttgggtttagacccatctgttaagcgtttgatgatgtatcaacaaggttgttttggcggaggttcttccttaagactagctaaggatttggctgaaaataacaagggtgctagagtgttggtcgtttgttccgaaataacggtcttgagtttccatgcaccatcggatactgaactagacgtattggttggtcaggccttattttctgatggtgcttccgccgttattgtcggctctgacccaatattaaccgttgaaagacctttgttcgagatcgtattcgccactcaaactttacttccagactccggtcacgctatttacggtaacttgtgcgaatcaggtttggtcgctcacatgcataaagatgttcccatccttgtgtcaaaggacatagaaaagattattgaagaagttttcagaccattgggaatttctgattggaatagcatcttttgggtcgctcacgctggtggtcgtgccattttagatcaaatcgaggttaagctaggtttgaagcctgaaaagttgagagctgcaaggcatgtaatgagtgagtacggtaacatgggttctgcttgtgttttgtttgtcctggacgaaatgagaaaagcttcgattaaggagggtttaggtaccactggcgaaggactagaatggggtgcattgtgcggtttcggtccaggtttgacaattgaaactatcgttttgcactccatctctatttaa

SEQ ID NO: 197 - DNA, 1200 bp, Artificial Sequence
  Synthetic
atgatgcctgcttcaagatgcgcctccaaccccctggttgctccaggtttgttcatcgtcggactaggttcgcaatatccaccataccttttagaccatgaaaagttgacatgttttgcaggtcgtttccacgatattaggcgtccaggcttgcagaaattgttacaaattaatgcttctaccggtatagagactagatctagtatcagaagctacgaaacgggatttgcctgtgatcctgtaccaccatccattgctgacctagacgaattgttcagaagagatggtgttgatcttgcagtgcaagcctgtatgaaggctatgaaagaagctggtgttttgccagaacaaatcactcacaccgtcagtgtcacttgtaccaaccaaggtaaccccggttacgacttattggttaatgaaagattgggcttgccagagagaacatctcgtatcctgctacatggtgttggttgtgctggtggtttgtctattatgagagtcgcatcccaagttgcttgcggtgctaccatgagaggtagacaggcctgtatattagtctatgcttgtgaactttgcactcctaacgtaaggcacgatttagctgaagccgaacaatgtactgacttgtctaaggtcaatattgctggagcattattctctgacgctgccgctgcatttattttatgtaacaagactgccttggaagagtcatcggcttccccaattttcgaattgatcgaatgggataatgccttgatcccagataccatgcaacatttgacgtgttacacagacccttatggttttagatccgttctgactaaggatataccaacttacgccaaaggtgctattggcccaatgttccacaagttgcttccctcttatgaagaacaagttctagctgctgatatccacttgggtattgatgactttgactgggccgttcacccaggaggtaaggctttgattgatggcgttcaagaaaccatgcagctaaccgaagaccaattgcaagcttctagggaaatctacagaaccagaggtaactcatcgtcaccaactatcttaagcgtgctggatagattgagaacttacgagaaacaacgtggtcatgttgtcgctgcatctttcggtcctggtatggctattgaaatggttatgctgaagagatgtgaagtggctggtggtggtcagtaa

SEQ ID NO: 198 - DNA, 1197 bp, Artificial Sequence
  Synthetic
atgccagcctcaaaatgcgcaaattctcccttggtcgctccaggtctattcatcgtaagcctgggatctcagtatcctccatacttacttaaccatgaaaagttaacttgttttgccgagaggttctacgacattcgtagaccaggtttgagaaagttgttgcaaataaacgcttcgacgggcattgaaaccagaagttccatcagatgttatgaaactggttttgcttgtgattccgttccaccttctattgctgatttggacgaattattcagaagagatggtgttgacttaacagtccaagcttgtatgaaggcaatgaaagaagctggtgttctaccagagcaaatcacccacactgttggtgtgacctgcactaatcaaggtaacccaggatacgatttgttggtcaacgaaaagttgggtcttccagaaaggacctctcgtatattgttacacggtgttggttgtgccggtggtctatccattatgagagttgcctcacaagtcgcttgtggcgaaaccatgagaaagcgtcctgcttgcatcttggcttacgcctgtgagttgtgtacgcctaatgttagacatgaccttgtagaagcagaacagtgcactgatttgtctaaagtgaacattgctggagctttatttagcgatgctgctgctgctttcattttgtgtaacagaactgccttagaaggtatcaatgcatcgccaatatttgaattgattgaatgggactatgccctgatcccagatacaatgcaacacctaacatcctacactgacccatacggtttcagatctgtcttgacaaaggatatccccacttacgctagagcagctattggtccaatgttccacagattgttgcctagttatgaagaacaagttttcgccgctgacatgcaacttggtgttgtcaactttgactgggccgttcatccaggtggtaaggctcttattgatggcatccaagaaaccatgcaattgaccgaggatcagttgagagcttctcgtgagatatatagaacgagaggaaattcctcgtccccaactatcttaagtgtcctagatagattaaggacctacgaaaagaagaggggtcacgttgtagctgcttcttttggtccaggtatggccattgaaatggttatgttgaaaagatgtgaagttgctggtggagaaagataa

SEQ ID NO: 199 - DNA, 1197 bp, Artificial Sequence
  Synthetic
atgccagcaagtaagtgtgctaactcacctcttgttgccccaggtttattcatcgtcggcttgggatcccaatatcccccatacctactggatcatgaaaaattgacttgctttgctggtcgtttctacgacataaggcgtccaggtttacagaagttgctacaaattaatgctagcaccggtatcgagacaagatcttctattagatcttatgaaacgggttttgcttgtggtcctattccaccatccatcgccgacttggatgaacttttcagacaagacggtgtagatttggctgtgcaagcttgtatgaaggccatgaaagaagccggagttttgccagagcaaattactcacaccgtttcggtcacttgcaccaaccaaggtaatcccggttacgatttgttagttaacgaaagattgggactgccagaaagaacttctaggatattattgcacggtgtgggttgtgctggtggtttgtccatcatgagagtagcaagtcaggttgcttgtggtgctacaatgagaggcaagcctgcttgtattctggcttacgcttgtgaattatgcaccccaaatgttcgtcatgacttggcagaagctgaacaatgtatggatttgattaaggtcaacatcgccggtactttattctctgacgctgccgctgcctttattttgtgtaacaagaccgctttggaagaggtcaatgcatctccaatcttcgaattaatcgagtgggataacgctttgttacctgatactatgcaacacttgacgtgttatacggacccatacggtttcagaagtgtcctgtccaaagatattccaacctacgccaaaggtgctatcggcccaatgtttcataaactattgccatcatacaaggaacaagtttcagcagcagacaagcacttaggtatagacgatttcgactgggccgttcatcctggtggtaaggctttgatagatggtgtacaggaaaccatgcaattaaccgaagatcaactgagagcttctcgtgaaatttataagactagaggcaactcctctagtcccactattctatccgtcttggacagattgagaacatatgaaaagaatagaggtcacgttgttgctgcctcttttggtccaggcatggtcatcgaaatggtcatgttaaagagatgcgaaagaaacagcccaacagcttaa

SEQ ID NO: 200 - DNA, 1170 bp, Artificial Sequence
  Synthetic
atgatgtcagtcgaagagattagacgtgctcagagggccgacggcccagcaaccatcttagctataggtacaagtacgcccccttattgtgtagaacaatctacttacccagattactattttagaatcaccaaatctgaacacaagactgaactaaaggacaagttcaaaagaatttgcgaaaagagctgtgttaaaagaagatacatgttcttgacagaagaggttcttaaggaaaacccaaatatgtgtgctcatatggccccatcgctggatgctagacaagacatggctattgtcgatgttcctaagttgggtaaggaagcagctatgaaagccatcaaggaatgggatcaaccaaagtccaagataactcacttgatctttcatactacctccggagctgagatgccaggtgctgactaccaattgaccaagctattaggtttgcgtccatctgtgaaaagattcatgatgtatcaacagggttgttttgccggtggtactgtcattagaatggctaaggacttagcagaaaacaataggggagctagggttttggttgtttgcagtgaaattacggctgtcactttcagaggtccatccgaaacaaaccctgatggtcttgtcggtcaagcattgttcggtgatggagctgccgctataattatcggtgccgatcctatcccagaagttgaaaagccattattccaattggttaccgctggtcaatcgattttgccagactctgatggtgcaatttctggccaactaagagaggctggtttgaccttacacctggtaagagaagttcccaacctgattgccaagaacatcgaagacagcttgatcgaagcttttgaaccattgggtatttccgactggaactcaatcttttggatagctcatcccggtggcccagccattttggacaagatcgaagcaaaattagctttgaagcctgaaagacttcgtgctactagacacgttttgtctgagtacggtaatctttcttcagcttctgtgttattcatattggatgaaatgagaaaatcctctcgtgaaaagggtttttcaactaccggtgaaggtttggattggggcgtgttattcggttttggtccaggtttgacggtcgaatccgtcgttttacactcggtccctgcttaa

SEQ ID NO: 201 - DNA, 1197 bp, Artificial Sequence
  Synthetic
atgtccgctagtgaaaattcttcaaaccccccagtacctccaggcctattcatcgtcggattgggttcgcagtatccaccatacttattggatcacgagatgctgacacgttttgccggtagattctacgacactcaaaggccaggtttgcataagcttttgcaaataaacaccagcaccggtattgaaactagaagttctatcagatcttatgaaacgggttttgcttgcaattctgtgcctccatccattgcagatttagacgaactattcagacaagatggtgttgaccttgccgttcaagcttgtactaaagttatgaaggaggctggtattttgagagaacaaattaccgatactgtctccgtcacttgtaccaaccaaggtaacccaggttacgacttattggttaatgaaagattgggcttgcccgaacgtacttctaggatcctattacacggtgtgggttgtgctggcggtctttcaataatgagagtcgcttcacaggtcgcctgtggtgctaccatgagaggtaaacctgcatgtatcttggcttacgcctgcgaattgtgtacaccaaacgttagacatgatttggctgaagctgaacaatgcatggacctgtcagaagttaacgttgctggtgccttgttctctgatgcagctgctgcctttattttatgtaatgaggctgcattaaaggaaatcaaggcctccccaattttcgaattggttgaatgggacaacgctttaattcctggaacgatgcaacacctagtgtgttatactgatccatacggattcagatctaccttggctaaagatatcccaaagtacgcaaaggaagctgtcggtccaatgtttcgtaaattgttgccttcctatgagggtcaagttttctcgaaggacaagcatttggacacagatgattttgactgggctttgcacccaggaggtaaggccctgatcgatggtgtacaagaaactatgcagttaatggatgaccaaattagagcatccagggagatttacagaaccagaggtaattcttcttctccaacggttcttagcgtcttggatagattgagaacctacgaaaaacgtagagatcacgttgttgctgcttctttcggtcccggtttagtaatcgaaatggctatgttgaagagatgtgacatcgctggcagtagaagataa

SEQ ID NO: 202 - DNA, 1221 bp, Artificial Sequence
  Synthetic
atggctcctttgttccacggtacgccaccacccgaaatcagaaaccataatgacgattccctgagtaaacgtgtgatatctgtcgtaggaactggtgcacactacccaccatatgagcttagatcggatgaattggaaaagctaatttctgcttttcatgaccctgaagatccagctgccaggaagacattatacattaacgagaagtcaaaaatccaatacagaagaaccgccgttccattcgacgacccattttggtctgatccaaagttgcctgatatcgctgactgtgatgttttgttcagaaaatatggtgtcccagttgcagaagaagctgctagaaaggccttagctgactggaatggtagcttcaacgatattactcacgtcgttgttgtcacctgtactaatactgccaacccaggcttggattacatgatctgcgaacgtctgggtttgagaaaaaacgttcagcgtaccttattgcacggtgtcggttgtgctggtggcgctgccgccctaagaaccgctaatgaacttttgttaggagctgcttttcaaggtaagccaggtagagctttggtggttgcatgtgaaatttgcaccatcttcttcagatccatgttggaggacattgttaaggcacaagaagctaacattgccatgactctatttggtgacggtgcttctgcaatggttttatctaatggcatctgtcctaagacatcagaaagagctccattgtggaacatattgaactgtaggactactttgctagaagactctgtctccagtattcaatttaacatcagaccacatggttaccaccccgtcatcaccaaggaagtacctggacaaacatccgccgctctgccaagtggtttccaagatttaattagctctaccccatccttgtgttctgataagagcaatttcgacccatcctcttatgattgggccttgcatcctggtggttactcgatcgctgtcttagctcaaaacgctttgggtattactgaacatcacctaaggaaaacatatgaagtttaccgtttgagaggtaacacctcgtcttccactgtcataagtgttgtaaacgaactggctagagaacaaggcactcctgagtccggtagagacaaggttattgttgccgcttttggtccaggtataactatggagatggctgttatggcaagaccagtgtactctgccacctaa

SEQ ID NO: 203 - DNA, 1197 bp, Artificial Sequence
  Synthetic
atgccagcttcaaagtgtgccaattcccctctagtcgctccaggtttgttcattgtaggccttggttcgcaataccccccttatttattgaaccacgaaaaattgagctgctttgcagagcgtttctacgatatcaggaggccaggtttacagaagttgctgcaaataaacgcttctactggtatcgaaaccagatcttctattagaccatacgaaacaggatttgcctgtgactcagtgccaccaagtattgctgacttggatgaattattcagaagagatggtgtcgacttggctgttcaagcatgtatgaaggctatgaaagaagccggtgttttacccgagcaaatcacgcataccgttggagtcacttgtactaaccaaggtaatccaggttatgatctgttggttaacgaaaagttgggtttgccagaaagaacttctcgtattttgcttcacggagtgggttgcgctggcggtttatccataatgagagttgcaagtcaggtcgcttgtggtgctaccatgagaaagcgtcctgcctgtatcctagcttacgcttgcgaattgtgtacgccaaatgttagacatgacttggcagaagctgagcaatgtactgatttatctaaagttaacatcgctggtgctttgttttccgacgccgctgctgccttcattttatgtaatagaacagcccttgaaggtattaacgcttcccctatctttgaattgattgaatgggatcacgctttaataccaaacaccatgcaacatctaacttcgtataccgacccatacggtttcagatccgttttgacaaaggacatcccaacatatgccagagcagctattggtcctatgttccacagattgcttccatcttacgaagaacaagtcttcgccgctgatatgcaactgggcgtcgtcgactttgattgggctgttcacccaggtggtaaggctctaattgatggtatccaggaaaccatgcaattgactgaagaccaattgagagcctctagggagatttacagaactcgtggtaattcgagtagcccaactattttgtccgtattggatagattgagaacatatgagaagaaaagaggtcatgttgttgccgcctctttcggtccaggtatggctatcgaaatggtcatgttaaagagatgtgaagtagctggtggtgaaagataa

SEQ ID NO: 204 - DNA, 1185 bp, Artificial Sequence
  Synthetic
atgccaggtttagaaaacagaaagaaagtcgaggctcctaagcgtgccgaaggactagcaactatattggctatcggtagagctaatccacccaacgctatggaacagtccacatttccagacttctatttcagggttacgaatagcgaacatctggtaggtttggaaaagaaatttgaaagaatttgcgagaagaccgccattagaagaagacacttcgtgtggaacggtgaaatcttgaacgctaatccatgtcttagaactcacatggaaccatctttgaacgtccgtcaaaaaattgctgttgccgaaatccctaagctgggcgctgaagcagcttcaagagctattgaggaatggggtcaaccaaagtcgcatataacccacttgatcttttgtactacctctggtatggatttacctggtgcagattacaaattaactagaattttgggcttgaacccaaatgttcaaagggtcatgctataccaacaaggttgtttcgctggaggtactgttttgagattggccaaatgctttgccgaaagtcaaaagggtgctagagttttagtcgtctgttccgaaacgacaaccgttttggtgcgtgccccatctgaagactatcaggatgacctggtaactcaagctcttttcgccgacggtgcttcagctttaattgtcggtgctgatcctgacgaagaagctaaggagaggcgtatcttcactatcgtttctgctacacaagttattttgccagattctgatggtgcaatcggcggtcacttgggtgagggtggtcttaccgccaccttgcatagagatgtgcccctaataatttcaaagaacgtcagtaagtgtttggaagaagcattcgccccattaggcatctccgactggaatagcatattctgggctccacatcccggtggtagagcaattttggatcaagttgaagaaagagttggtttgaagccagagaaattatgggcttccagacacgttttggcagaatacggtaacatgtcttccgtgtgtgtccactttgttctggatgaaatcagaaagagaagcaccaaggaaggaaagactactaccggagaaggttttgactggggtgtcttgttcggtttcggtccaggattgactgttgaaacggttattctaagatcagtaccattgaactaa

SEQ ID NO: 205 - DNA, 1173 bp, Artificial Sequence
  Synthetic
atgccatccttagaatcaattaaaaaggcacccagggccgacggcttcgctagtatactagctatcggacgtgctaatcctgataacatcattgagcagagcgcctacccagacttttatttcagagtgacaaactcggaacaccttgttgatctgaagaaaaagtttcaaagaatttgcgaaaagactgctatcagaaagagacatttcgtctggaatgaagaatttttgaccgctaacccatgtttctctacttttatggataaatctttaaacgttagacaagaggtagctatttccgaaatccctaagttgggtgccaaagctgcaaccaaggccatagaagactggggtcaaccaaagtctcgtatcacgcatttgattttctgtactaccagtggtatggatttgccaggtgctgattaccaacttactcaaattttgggtttaaaccctaacgttgaaagagttatgctgtatcagcaaggttgtttcgcaggaggtacaactttgaggttggctaagtgtttggctgaatccagaaaaggtgccagagtcttagtcgtttgcgctgagacaaccactgtcttgtttagagctccatctgaagaacaccaagacgacttagttacccaagcactgttcgctgatggtgcctccgctgttatagtgggtgccgacccagacgaagctgctgatgaaagagcttctttcgtcatcgtttctacttcacaagtactattgccagatagcgccggtgccattggtggtcacgtttccgagggtggtttgctagctactttgcatcgtgacgtccctcagattgtttcaaagaatgtaggtaagtgtttggaagaagctttcaccccatttggtatcagcgactggaacagtatattctgggtcccacaccccggcggtagagctattcttgatcaagtcgaagaaagagttggcttgaagccagagaagttatctgtttctaggcatgttttggccgaatacggaaatatgtcgtctgtatgtgtccactttgcattggatgaaatgagaaaaagaagtgctaacgaaggaaaagctaccacaggtgaaggtttggaatggggtgttctgttcggttttggtccaggtttgaccgtagaaactgtggttctaagatccgtccccctttaa

SEQ ID NO: 206 - DNA, 1209 bp, Artificial Sequence
  Synthetic
atggagccacttttacacggtacgccccctttggccctaagaatcaataacgacgtgccactgtcgaagcgtgttgtcagcgttgtcggcacaggtgctcattatccaagttacgaatttccttctgatgaattggaagaattgatttcaggagttcacgatccaaacgacccagctataaggaaaactttgcatattaatgagaagtccagaatccaatgtagatacactgccgtacccttagacgatccattctggaccgatccaaagttaccagacgtcgctgactgcgatgttttgttcagaaaatatggtgtacctgttgcagaagaagcagctagaaaggctctggctgattggaacggttccttgaaggatattacccacttggttgtagtcacttgtaccaacacagccaatccaggtcttgactacttgatctgtgaaagattaggtttgcatagaaacgttcagcgtactcttctacacggcgtcggttgcgctggtggtgtttctgctttgagaaccgccaacgaattgttgttaggtgctgcatttcaaggtcgtccaggaagagctctggttgtcgcttgtgaaatctgtactattttctttagatctatgttggaagacatagtgaaaacccaagaggcaaatgttgctatggccttgttcggcgatggtgcttcagccatggtcctatctaacggtatttgtactaagccatttgaaagagctccattatggaacatcttaaactccaggacaactttgttggaagactctttgagtagtcttcaattcaatattagaccatccggttacaatcctgtcattactaaagacgttcctggtcaaacttctgccgctttaccatcaggattccaagatttgatcgcttctacaccatcattgtgttccgataagtctaactttgatccttcgtcttatgattgggcacttcaccccggtggttactccatcgctgttctagcccagtccgctttgggtattactaagcatcacctgagaaaaacctacgatgtttacaggctaagaggtaacactagctcctcgacggtgatttccgtgattaatgaactggctaaggaacaagacaccccagaatctggtagagacaaggtcatagttgccgctttcggtcccggcatcaccatggagatggctgtaatggcaagaccaacctaa

SEQ ID NO: 207 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSCVLFVMDELRKRSLEEGKSTTGDGFEWGVLFGFGPGLTVERVVVRSVPIKY

SEQ ID NO: 208 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSPTVLFVMDELRKRSLEEGKSTTGDGFEWGVLFGFGPGLTVERVVVRSVPIKY

SEQ ID NO: 209 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMGQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 210 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPYGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 211 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGLDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 212 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSRITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 213 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLEEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 214 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIDEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 215 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSSEEGKSTTGDGFEWGVLFGFGPGLTVERVVVRSVPIKY

SEQ ID NO: 216 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLRQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 217 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLGVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 218 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTVDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 219 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGMDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 220 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADVHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 221 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERAIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 222 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTIIPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 223 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTADMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 224 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTIDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 225 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSATVLFVMDELRKRSLEEGKSTTGDGFEWGVLFGFGPGLTVERVVVRSVPIKY

SEQ ID NO: 226 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLREHGNMSSSTVLFVMDELRKRSLEEGKSTTGDGFEWGVLFGFGPGLTVERVVVRSVPIKY

SEQ ID NO: 227 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSSSTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 228 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNVEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 229 - protein, 385 aa, Artificial Sequence
  Synthetic
MNHLRAEGPASVLAIGTANPENILLQDEFPDYYFRVTKSEHMTQLKEKFRRICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 230 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEYGNMSSSTVLFVMDELRKRSLEEGKSTTGDGFEWGVLFGFGPGLTVERVVVRSVPIKY

SEQ ID NO: 231 - protein, 385 aa, Artificial Sequence
  Synthetic
MNHLRAEGPASVLAIGTANPENILLQDEFPDYYFRVTKSEHMTQLKEKFRKICDKSMIRKRNCYLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 232 - protein, 385 aa, Artificial Sequence
  Synthetic
MNHLRAEGPASVLAIGKANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 233 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQALFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 234 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHILSEHGNMSSSTVLFVMDELRKRSLEEGKSTTGDGFEWGVLFGFGPGLTVERVVVRSVPIKY

SEQ ID NO: 235 - protein, 385 aa, Artificial Sequence
  Synthetic
MNHLRAEGPASVLAIGTANPENILRQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 236 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWIAHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 237 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVASRHVLSEHGNMSSSTVLFVMDELRKRSLEEGKSTTGDGFEWGVLFGFGPGLTVERVVVRSVPIKY

SEQ ID NO: 238 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKIEEKLHLKSDKFVDSRHVLSEHGNMSSSTVLFVMDELRKRSLEEGKSTTGDGFEWGVLFGFGPGLTVERVVVRSVPIKY

SEQ ID NO: 239 - protein, 385 aa, Artificial Sequence
  Synthetic
MNHLRAEGPASVLAIGTANPENCLLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 240 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPKLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 241 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCMIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 242 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFCSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 243 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPGLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 244 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSKSDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 245 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVETVVVRSVPIKY

SEQ ID NO: 246 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGAIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 247 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEAPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 248 - protein, 385 aa, Artificial Sequence
  Synthetic
MNHLRAEGPASVLAIGTANPENILLQDEFPDYYFRVTKSEHMTQLKEKFRKICRKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 249 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLECLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 250 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttcttgcgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 251 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctctcctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 252 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgggtcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 253 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccatacggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 254 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcttggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 255 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctcgtattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 256 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttggaagaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 257 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcgatgagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 258 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagttctgaagaaggtaaatctaccacaggtgacggttttgagtggggtgtcttgttcggtttcggtcctggactaactgttgaaagagttgtcgtaagatccgttccaattaagtactaa

SEQ ID NO: 259 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaagacaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 260 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttggtgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 261 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactgttgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 262 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcatggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 263 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgacgttcattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 264 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagagggcaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 265 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcattcctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 266 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactgccgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 267 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactattgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 268 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctctgcaactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 269 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgagagaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 270 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctcttccagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 271 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacgttgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 272 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggagaatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 273 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaatacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 274 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctacttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 275 - DNA, 1158 bp, Artificial Sequence
  Synthetic
atgaatcatcttagagcagaaggtcctgcctccgtattagctatcggaaaggctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 276 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctttatttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 277 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatattttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 278 - DNA, 1158 bp, Artificial Sequence
  Synthetic
atgaatcatcttagagcagaaggtcctgcctccgtattagctatcggaaccgctaacccagagaacatactacgtcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 279 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattgctcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 280 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggcttcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 281 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaagattgaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 282 - DNA, 1158 bp, Artificial Sequence
  Synthetic
atgaatcatcttagagcagaaggtcctgcctccgtattagctatcggaaccgctaacccagagaactgtctactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 283 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaaaacttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 284 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtatgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 285 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttctgttctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 286 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaggccttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 287 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtaagtctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 288 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaactgttgtcgtaagatccgttccaattaagtactaa

SEQ ID NO: 289 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcgcaataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 290 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagccccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 291 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtagaaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 292 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaatgtctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 293 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGLGPGLTVERVVVRSVPIKY

SEQ ID NO: 294 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFAFGPGLTVERVVVRSVPIKY

SEQ ID NO: 295 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHNGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 296 - protein, 385 aa, Artificial Sequence; identical to SEQ ID NO: 208
  Synthetic

SEQ ID NO: 297 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTMGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 298 - protein, 385 aa, Artificial Sequence
  Synthetic
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMWSSTVLFVMDELRKRSLEEGKSTTGDGFEWGVLFGFGPGLTVERVVVRSVPIKY

SEQ ID NO: 299 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADCHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 300 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFWITHPGGKAILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 301 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMSSPSVLFALDEMRKMSIKQGKSTTGQGLEWGVLLALGPGLTVETIGLRSCVVAGYASE

SEQ ID NO: 302 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINFYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 303 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMSSPSVLFALDEMRKMSIKQGKSTTGQGLEWGVLLALGPGLTVETIGLRSCVVAGYASE

SEQ ID NO: 304 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFWITHPGGKAILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 305 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLGLGPGLTVETIGLRSCVVAGYASE

SEQ ID NO: 306 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLGLGPGLTVETIGLRSCVVAGYASE

SEQ ID NO: 307 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMIHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 308 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINFYISKELPKCIANNIEQCLIEMFTPFGINDWNTLFYVVHNGGPTILRGIEEKLGLDKDKLEASWHVLREYGNMSSPSVLFALDEMRKMSIKQGKSTTGQGLEWGVLLALGPGLTVETIGLRSCVVAGYASE

SEQ ID NO: 309 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLAFGPGLTVETIGLRSCVVAGYASE

SEQ ID NO: 310 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMIHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 311 - protein, 389 aa, Artificial Sequence
  Synthetic
MSQEYRQGVATILAIGTANPPNCFCQSEYPDYYFRATNSEHMTDLKQKFKRICERSAIQKRYMHLSEDMLKENPNLCIYRAPSLDVRQDILIEEVPKLGKEAALKAIKEWGQPKSKITHLIFCTSCCVTMPGADYQFAKLIGLRPSIQRFMIYGQGCYAAGTALRLAKDLVENNRGARVLIVCSELMLSCFHAPSETHLDILVGSAIFSDGAAALIVGANLDTTNNERPLFEIVSANQTVIPDSEDMMHGKIGEMGINYYISKELPKCIANNIEQCLIEEFTPFGINDWNTLFYVVHNGGPTILRGIEEKLGLDKDKLEASWHVLREYGNMWSPSVLFALDEMRKRSIKEGKSTTGQGLEWGVLLALGPGLTVETIGLRSCVVAGYANE

SEQ ID NO: 312 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINFYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 313 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHPGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 314 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHPGGPTILRGIEEKLGLDKDKLEASWHVLREYGNMWSPSVLFALDEMRKMSIKQGKSTTGQGLEWGVLLALGPGLTVETIGLRSCVVAGYASE

SEQ ID NO: 315 - protein, 389 aa, Artificial Sequence
  Synthetic
MSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINYYISKELPKCIANNIEQCLIEMFTPFGINDWNTLFYVVHNGGPTILRGIEEKLGLDKDKLEASWHVLREYGNMWSPSVLFALDEMRKMSIKQGKSTTGQGLEWGVLLAFGPGLTVETIGLRSCVVAGYASE

SEQ ID NO: 316 - protein, 396 aa, Artificial Sequence
  Synthetic
MASSIENMSQETRQGVATILAIGTANPPNCFCQSEYPDFYFQLTNSQHMTQLKQKFQRICERSAIQKRYMHLSEDMIKGNPNLSIYRAPSLDVRQEILITEVPKLGKEAALKAIKEWGQPLSNITHLIFCTSCCATAPTADYHFANLIGLKHSIQKFFIYGQGCYAAGTALRLSKDLVENNVDSRVLIVCSELMLSCFHAPSETHLDILVGSAIFSDGAAALIVGANLDTNKNERPLFEIISANQTVIPDSETMMHGKICEMGINFYISKELPKCIANNIEQCLIEMFTPFGINDWNTLFYVVHNGGPTILRGIEEKLGLDKDKLEASWHVLREYGNMSSPSVLFALDEMRKMSIKQGKSTTGQGLEWGVLLALGPGLTVETIGLRSCVVAGYASE

SEQ ID NO: 317 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFYWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 318 - protein, 390 aa, Artificial Sequence
  Synthetic
MPSLESVKKSNRADGFASILAIGRANPENFIEQSTYPDFFFRVTNSEHLVNLKKKFQRICDKTAIRKRHMVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 319 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVMHSVPI

SEQ ID NO: 320 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMANSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 321 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLAEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 322 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEEILNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 323 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLPPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 324 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSKEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 325 - protein, 390 aa, Artificial Sequence
  Synthetic
MPSLESVKKSNRADGFASILAIGRANPENFIEQSTYPDFFFRVTNSEHLNNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 326 - protein, 390 aa, Artificial Sequence
  Synthetic
MPSLESVKKSNRADGFASILAIGRANPPNFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 327 - protein, 390 aa, Artificial Sequence
  Synthetic
MPSLESVKKSNRADGFASILAIGRANPENFIEQQTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 328 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIPEIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 329 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGCSALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 330 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGMATTGEGLDWGVLFGFGPGLTVETVVLHSVPI

SEQ ID NO: 331 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAITEIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 332 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQDWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 333 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADVQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 334 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFDPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 335 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGIDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 336 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDHGVLFGFGPGLTVETVVLHSVPI

SEQ ID NO: 337 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPEETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 338 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLKEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 339 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPQKLIVSRHVLAEYGNMSSVCVHFALDEMRKRSKKEGKATTGEGLDWGVLFGFGPGLTVETVVLHSVPI

SEQ ID NO: 340 - protein, 390 aa, Artificial Sequence
  Synthetic
MPSLESVKKSNRADGFATILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 341 - protein, 390 aa, Artificial Sequence
  Synthetic
MPSLESVKKSNRSDGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 342 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLREYGNMSSVCVHFALDEMRKRSKKEGKATTGEGLDWGVLFGFGPGLTVETVVLHSVPI

SEQ ID NO: 343 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAENRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 344 - protein, 390 aa, Artificial Sequence
  Synthetic
MPSLESVKKSNRADGFASIFAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 345 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNAHPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 346 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIAEIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 347 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHILAEYGNMSSVCVHFALDEMRKRSKKEGKATTGEGLDWGVLFGFGPGLTVETVVLHSVPI

SEQ ID NO: 348 - protein, 390 aa, Artificial Sequence
  Synthetic
MPSLESVKKSNRADGFASILAMGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 349 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNICRVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 350 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFHWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 351 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAAKKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 352 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPVGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 353 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSAITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 354 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADFQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 355 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQELGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 356 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADIQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 357 - protein, 390 aa, Artificial Sequence
  Synthetic
MPSLESVKKSNRADGFASILAIGRANPENFIEQSTYPDFFFRVTNSEHLVNLKEKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 358 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLCTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 359 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTALRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 360 - protein, 390 aa, Artificial Sequence
  Synthetic
MPSLESVKKSNRADGFASILAIGRANPENFIEQSTYPDFFFRVTTSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 361 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSETGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 362 - protein, 390 aa, Artificial Sequence
  Synthetic
MPSLESVKKSRRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 363 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDALVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 364 - protein, 390 aa, Artificial Sequence
  Synthetic
MPSLESVKKSNRADGFASILAIGRANPENFIEQSTYPDFFFRVTNSEHLVNLKKKFQRICRKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 365 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKDLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 366 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCMGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 367 - protein, 390 aa, Artificial Sequence
  Synthetic
MPSLESVKKSNRADGFASILAIGRANPANFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 368 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAARKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 369 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSPEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 370 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFAFGPGLTVETVVLHSVPI

SEQ ID NO: 371 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGDCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 372 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLRANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 373 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPVSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 374 - protein, 390 aa, Artificial Sequence
  Synthetic
MPSLESVKKSNRADGFASILAIGRANPENFIEQSTYPDFFFRVTNSEHLVNLKKKFQRICDKTAIRKRYFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 375 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDSLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 376 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAAEKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 377 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPELGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 378 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADCQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 379 - protein, 390 aa, Artificial Sequence
  Synthetic
MPSLESVKKSNRAPGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 380 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIEEIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 381 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSAPI

SEQ ID NO: 382 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLSRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 383 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEAGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 384 - protein, 390 aa, Artificial Sequence
  Synthetic
MPSLESVKKSNRADGFASILAIGKANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 385 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQITQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 386 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSSKEGKATTGEGLDWGVLFGFGPGLTVETVVLHSVPI

SEQ ID NO: 387 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGVDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 388 - protein, 390 aa, Artificial Sequence
  Synthetic
MPSLESVKKSNRADGFASILAIGRANPENFIEQSTYPDFFFRMTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 389 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLIPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 390 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLSTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 391 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPNLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 392 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSPCVHFALDEMRKRSKKEGKATTGEGLDWGVLFGFGPGLTVETVVLHSVPI

SEQ ID NO: 393 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSTPI

SEQ ID NO: 394 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTVVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 395 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDCLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 396 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLTTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 397 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLRVSRHVLAEYGNMSSVCVHFALDEMRKRSKKEGKATTGEGLDWGVLFGFGPGLTVETVVLHSVPI

SEQ ID NO: 398 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGLGPGLTVETVVLHSVPI

SEQ ID NO: 399 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASAIIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 400 - protein, 390 aa, Artificial Sequence; identical to SEQ ID NO: 361
  Synthetic

SEQ ID NO: 401 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCIGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 402 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGMEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 403 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAGREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 404 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPGIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 405 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKQEGKATTGEGLDWGVLFGFGPGLTVETVVLHSVPI

SEQ ID NO: 406 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSACVHFALDEMRKRSKKEGKATTGEGLDWGVLFGFGPGLTVETVVLHSVPI

SEQ ID NO: 407 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTYMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 408 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAMGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 409 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMWSVCVHFALDEMRKRSKKEGKATTGEGLDWGVLFGFGPGLTVETVVLHSVPI

SEQ ID NO: 410 - protein, 390 aa, Artificial Sequence
  Synthetic
MPSLESVKKSNRADGFASILAIGRANPPNFIEQSTYPDFYFRVTNSEHLVDLKEKFQRICDKTAIRKRHFVWNEELLNAHPEICTYMAPSLDVRQEMARREIPKLGAEAAQKAIQEWGQPKSKITHLIFCTTSGMDMPGADYQLTQLLGLPPNIERVMLYQQGCFAGGTTLRLAKDLAENRPGARVLVVCAETTAVLFRAPSEEHLDDLVTQALFADGASALIVGADPDETANERAFFVIVSTSQVLLPDSEGAIGGHVGEAGLIATLHRDVPQIVSKNVEKCLEEAFKPLGISDWNSIFWVPHPGGRAILDQVEERVGLKPEKLIVSRHVLAEYGNMSSVCVHFALDEMRKRSKKEGKATTGEGLEWGVLFGFGPGLTVETVVLHSVPI

SEQ ID NO: 411 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFALGPGLTVETVVLHSVPI

SEQ ID NO: 412 - protein, 390 aa, Artificial Sequence
  Synthetic
MPSLESVKKSNRADGFASILAIGRANPPNFIEQSTYPDFFFRVTNSEHLVNLKKKFQRICDKTAIRKRHFVWNEELLNANPCLCTFMDPSLNVRQEFAIREIPKLGAEAARKAIQEWGQPKSRITHLIFCTTSGMDLPGADYQLTQILGLPPNIERVMLYQQGCFAGGTTLRLAKDLAESRKGARVLVVCAETTAVLFRAPSEEHLDDLVTQALFADGASALIVGADPDETAHERAFFVIVSTSQVLLPDSEGAIGGHVSETGLIATLHRDVPQIVSKNVEKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 413 - protein, 390 aa, Artificial Sequence
  Synthetic
MPSLESVKKSNRADGFASILAIGRANPPNFIEQSTYPDFYFRVTNSEHLVDLKEKFQRICDKTAIRKRHFVWNEELLNAHPEICTYMAPSLDVRQEMARREIPKLGAEAAEKAIQEWGQPKSKITHLIFCTTSGMDMPGADYQLTQLLGLPPNIERVMLYQQGCFAGGTTLRLAKDLAENRPGARVLVVCAETTAVLFRAPSEEHLDDLVTQALFADGASALIVGADPDETANERAFFVIVSTSQVLLPDSEGAIGGHVGEAGLIATLHRDVPQIVSKNVEKCLEEAFKPLGISDWNSIFWVPHPGGRAILDQVEERVGLKPEKLIVSRHVLAEYGNMSSVCVHFALDEMRKRSKKEGKATTGEGLEWGVLFGFGPGLTVETVVLHSVPI

SEQ ID NO: 414 - protein, 390 aa, Artificial Sequence
  Synthetic
MPSLESVKKSNRADGFASILAIGRANPPNFIEQSTYPDFFFRVTNSEHLVDLKEKFQRICDKTAIRKRHFVWNEELLNAHPEICTYMAPSLDVRQEMARREIPKLGAEAAEKAIQEWGQPKSKITHLIFCTTSGMDMPGADYQLTQLLGLPPNIERVMLYQQGCFAGGTTLRLAKDLAENRPGARVLVVCAETTAVLFRAPSEEHLDDLVTQALFADGASALIVGADPDETANERAFFVIVSTSQVLLPDSEGAIGGHVGEAGLIATLHRDVPQIVSKNVEKCLEEAFKPLGISDWNSIFWVPHPGGRAILDQVEERVGLKPEKLIVSRHVLAEYGNMSSVCVHFALDEMRKRSKKEGKATTGEGLEWGVLFGFGPGLTVETVVLHSVPI

SEQ ID NO: 415 - protein, 390 aa, Artificial Sequence
  Synthetic
MPSLESVKKSNRADGFASILAIGRANPPNFIEQSTYPDFFFRVTNSEHLVELKKKFQRICDKTAIRKRHFVWNEELLNAHPEICTYMAPSLDVRQEMARREIPKLGAEAARKAIQEWGQPKSKITHLIFCTTSGMDMPGADYQLTQLLGLPPNIERVMLYQQGCFAGGTTLRLAKDLAENRPGARVLVVCAETTAVLFRAPSEEHLDDLVTQALFADGASALIVGADPDETANERAFFVIVSTSQVLLPDSEGAIGGHVGEAGLIATLHRDVPQIVSKNVEKCLEEAFKPLGISDWNSIFWVPHPGGRAILDQVEERVGLKPEKLIVSRHVLAEYGNMSSVCVHFALDEMRKRSKKEGKATTGEGLEWGVLFGFGPGLTVETVVLHSVPI

SEQ ID NO: 416 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFYVVHNGGPTILDQVEERVGLKPEKLIVSRHVLAEYGNMSSVCVHFALDEMRKRSKKEGKATTGEGLDWGVLFGFGPGLTVETVVLHSVPI

SEQ ID NO: 417 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAMGGHVSEGGLIYTLHRDVPQIVSKNVGKCLEEAFTPLGISDWNSIFYVVHNGGPTILDQVEERVGLKPEKLIVSRHVLAEYGNMWSPCVHFALDEMRKRSKKEGKATTGEGLDWGVLFALGPGLTVETVVLHSVPI

SEQ ID NO: 418 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIYTLHRDVPQIVSKNVGKCLEEAFTPLGISDWNSIFWVPHNGGRAILDQVEERVGLKPEKLIVSRHVLAEYGNMWSPCVHFALDEMRKRSKKEGKATTGEGLDWGVLFALGPGLTVETVVLHSVPI

SEQ ID NO: 419 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIYTLHRDVPQIVSKNVGKCLEEAFTPLGISDWNSIFWVPHPGGRAILDQVEERVGLKPEKLIVSRHVLAEYGNMWSVCVHFALDEMRKRSKKEGKATTGEGLDWGVLFGFGPGLTVETVVLHSVPI

SEQ ID NO: 420 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIYTLHRDVPQIVSKNVGKCLEEAFTPLGISDWNSIFWVPHNGGRAILDQVEERVGLKPEKLIVSRHVLAEYGNMWSVCVHFALDEMRKRSKKEGKATTGEGLDWGVLFGFGPGLTVETVVLHSVPI

SEQ ID NO: 421 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttaggtcctggactaactgttgaaagagttgtcgtaagatccgttccaattaagtactaa

SEQ ID NO: 422 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcgctttcggtcctggactaactgttgaaagagttgtcgtaagatccgttccaattaagtactaa

SEQ ID NO: 423 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcacaatggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 424 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctctccaactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 425 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactatgggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgagctcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 426 - DNA, 1158 bp, Artificial Sequence
  Synthetic
atgaatcatcttagagcagaaggtcctgcctccgtattagctatcggaaccgctaacccagagaacatactactgcaagacgaatttccagattactatttccgtgttacgaaatcggaacacatgacacagttgaaggaaaagttcaggaagatttgtgacaaatcaatgattagaaagagaaattgctttttgaacgaggaacacttaaagcaaaaccccagattggtcgaacatgaaatgcaaactttggatgctagacaagatatgcttgttgtggaagtcccaaaattgggcaaggacgcttgtgccaaggctatcaaggagtggggtcaaccaaaatctaaaattactcacttgatcttcacctctgcaagcactactgatatgcctggtgccgactaccattgtgctaagttattgggtttgtccccatctgttaagagagttatgatgtatcaactgggttgttacggtggtggcaccgtcttgcgtattgctaaggatatcgctgaaaataacaagggtgctagagtcttagccgtttgctgtgatataatggcttgtctattcagaggaccaagtgaatctgacttggaattgctagtgggtcaggctatttttggtgatggtgccgctgctgttattgtcggtgccgaaccagacgaatccgttggtgagaggccaatctttgaattggtttcaaccggtcaaaccatcttacctaactccgaaggcactataggtggtcacattagagaagccggtctgatcttcgacttgcataaagatgtcccaatgcttattagtaataacattgagaaatgtttgatcgaagcattcacaccaatcggtatttctgactggaactcgatcttctggattactcaccctggcggtaaggccatcctggacaaggtagaagaaaagttgcacttaaagagcgataaattcgtggactcccgtcatgtcttgtctgaacacggaaatatgtggtcttctactgttctttttgttatggatgaactaagaaagagaagtttggaagaaggtaaatctaccacaggtgacggttttgagtggggtgtcttgttcggtttcggtcctggactaactgttgaaagagttgtcgtaagatccgttccaattaagtactaa

SEQ ID NO: 427 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactgtcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 428 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttggattacccacccaggtggtaaggccattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 429 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgagttccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 430 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaacttctacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 431 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgagttccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 432 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttggatcactcacccaggtggtaaagccattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 433 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactaggtttgggtcccggtcttaccgtcgagacaattggtttaagatcttgtgttgttgccggttatgcttccgaataa

SEQ ID NO: 434 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactaggtttgggtcccggtcttaccgtcgagacaattggtttaagatcttgtgttgttgccggttatgcttccgaataa

SEQ ID NO: 435 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgattcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 436 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaacttctacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtcctccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 437 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttcggtcccggtcttaccgtcgagacaattggtttaagatcttgtgttgttgccggttatgcttccgaataa

SEQ ID NO: 438 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgattcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 439 - DNA, 1170 bp, Artificial Sequence
  Synthetic
atgagtcaggaatacagacaaggtgttgccaccatcttagctattggaactgctaatcctccaaactgcttttgtcaatcagaataccccgactattatttcagggcaactaatagcgagcatatgacggatttgaaacagaagtttaagcgtatctgtgaaaggtccgctattcaaaagagatacatgcacctgtctgaagatatgctaaaggaaaacccaaatttatgtatctacagagccccatctcttgatgtgagacaagacatcttgattgaagaagtcccaaaattgggcaaggaagcagctttgaaagctatcaaggaatggggtcaacctaagtcaaaaattacccacctgattttctgtacttcttgttgcgttaccatgccaggtgctgactatcaatttgccaagttgatcggtttaagaccatcaattcaaagattcatgatatacggtcaaggttgttacgctgctggtacagccctaagattggctaaggacctagttgagaataaccgtggtgccagggtccttatcgtttgttcggaattgatgttaagttgctttcatgctccatccgaaactcacttggacatcttggttggaagcgctattttctctgatggtgcagctgctttgattgtaggtgccaacttagacaccacaaacaatgagcgtccattgtttgaaatagtctctgcaaaccagactgtcatccctgattccgaagatatgatgcacggtaaaattggcgaaatgggcatcaactattacatttccaaggaattaccaaagtgtatcgctaataatatagaacaatgcttgattgaagagttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagagatctattaaggaaggtaaatctactactggtcaaggcttggaatggggagttttactagctttgggtcccggtcttaccgtcgagacaattggtttaagatcttgtgttgttgccggttatgctaacgaataa

SEQ ID NO: 440 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaacttctacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 441 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacccaggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 442 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacccaggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 443 - DNA, 1170 bp, Artificial Sequence
  Synthetic
atgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaactattacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtggtccccaagtgttctgttcgctttggacgaaatgagaaagatgtctattaagcaaggtaaatctactactggtcaaggcttggaatggggagttttactagctttcggtcccggtcttaccgtcgagacaattggtttaagatcttgtgttgttgccggttatgcttccgaataa

SEQ ID NO: 444 - DNA, 1191 bp, Artificial Sequence
  Synthetic
atggcatcttccatagagaacatgagtcaggaaacaagacaaggtgttgccaccatcttagctattggaactgctaatcctccaaactgcttttgtcaatcagaataccccgacttctatttccaactaactaatagccaacatatgacgcaattgaaacagaagtttcaacgtatctgtgaaaggtccgctattcaaaagagatacatgcacctgtctgaagatatgattaagggtaacccaaatttatcgatctacagagccccatctcttgatgtgagacaagaaatcttgattaccgaagtcccaaaattgggcaaggaagcagctttgaaagctatcaaggaatggggtcaacctttgtcaaacattacccacctgattttctgtacttcttgttgcgctaccgccccaactgctgactatcattttgccaacttgatcggtttaaagcactcaattcaaaaattcttcatatacggtcaaggttgttacgctgctggtacagccctaagattgtctaaggacctagttgagaataacgtagattccagggtccttatcgtttgttcggaattgatgttaagttgctttcatgctccatccgaaactcacttggacatcttggttggaagcgctattttctctgatggtgcagctgctttgattgtaggtgccaacttagacaccaacaagaatgagcgtccattgtttgaaataatatctgcaaaccagactgtcatccctgattccgaaactatgatgcacggtaaaatttgtgaaatgggcatcaacttctacatttccaaggaattaccaaagtgtatcgctaataatatagaacaatgcttgattgaaatgttcacgcctttcggtatcaatgattggaacaccctgttttatgttgtccacaacggtggtccaacgattttgagaggtattgaggaaaagctaggattggacaaggataaattagaagcttcttggcatgtgttgagagaatacggtaacatgtcttccccaagtgttctgttcgctttggacgaaatgagaaagatgtctattaagcaaggtaaatctactactggtcaaggcttggaatggggagttttactagctttgggtcccggtcttaccgtcgagacaattggtttaagatcttgtgttgttgccggttatgcttccgaataa

SEQ ID NO: 445 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcatttttactggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 446 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcatatggtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 447 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttatgcactctgttccaatataa

SEQ ID NO: 448 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggctaactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 449 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggctgaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 450 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaaattttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 451 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgcctcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 452 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccaaggaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 453 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttaacaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 454 - DNA, 1173 bp, Artificial Sequence
  Synthetic
atgcccagtttagagtcagttaagaaatccaatcgtgccgacggcttcgcatcgattctggctataggtagagctaaccctccaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 455 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagcaaacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 456 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattccagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 457 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggttgctctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 458 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtatggctacaaccggtgagggtttagactggggtgttttgttcggcttcggtccaggattaactgtcgaaaccgtcgttttgcactctgttccaatataa

SEQ ID NO: 459 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattactgagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 460 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagattggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 461 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgacgttcaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 462 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcgaccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 463 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaattgatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 464 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagaccatggtgttttgttcggcttcggtccaggattaactgtcgaaaccgtcgttttgcactctgttccaatataa

SEQ ID NO: 465 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagaggagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 466 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttgaaggaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 467 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctcaaaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 468 - DNA, 1173 bp, Artificial Sequence
  Synthetic
atgcccagtttagagtcagttaagaaatccaatcgtgccgacggcttcgcaaccattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 469 - DNA, 1173 bp, Artificial Sequence
  Synthetic
atgcccagtttagagtcagttaagaaatccaatcgttcggacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 470 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttacgtgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 471 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaaaaccgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 472 - DNA, 1173 bp, Artificial Sequence
  Synthetic
atgcccagtttagagtcagttaagaaatccaatcgtgccgacggcttcgcatcgatttttgctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 473 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgcccacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 474 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattgctgagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 475 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatattttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 476 - DNA, 1173 bp, Artificial Sequence
  Synthetic
atgcccagtttagagtcagttaagaaatccaatcgtgccgacggcttcgcatcgattctggctatgggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 477 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatatttgtagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 478 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttcactggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 479 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccaagaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 480 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccgttggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 481 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccgctataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 482 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgacttccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 483 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaagagctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 484 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgacattcaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 485 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaaggaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 486 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgtgtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 487 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactgctttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 488 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccactagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 489 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaacgggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 490 - DNA, 1173 bp, Artificial Sequence
  Synthetic
atgcccagtttagagtcagttaagaaatcccgtcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 491 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgctttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 492 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcagaaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 493 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaagatttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 494 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtatgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 495 - DNA, 1173 bp, Artificial Sequence
  Synthetic
atgcccagtttagagtcagttaagaaatccaatcgtgccgacggcttcgcatcgattctggctataggtagagctaaccctgctaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 496 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccagaaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 497 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccccagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 498 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcgcattcggtccaggattaactgtcgaaaccgtcgttttgcactctgttccaatataa

SEQ ID NO: 499 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtgattgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 500 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgagagccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 501 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccagtttccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 502 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgttactttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 503 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagattctttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 504 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccgaaaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 505 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccagagttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 506 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactgtcaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 507 - DNA, 1173 bp, Artificial Sequence
  Synthetic
atgcccagtttagagtcagttaagaaatccaatcgtgcccctggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 508 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattgaggagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 509 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgccccaatataa

SEQ ID NO: 510 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgtcgagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 511 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaagccggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 512 - DNA, 1173 bp, Artificial Sequence
  Synthetic
atgcccagtttagagtcagttaagaaatccaatcgtgccgacggcttcgcatcgattctggctataggtaaggctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 513 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaaatcacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 514 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatcttccaaagaaggtaaggctacaaccggtgagggtttagactggggtgttttgttcggcttcggtccaggattaactgtcgaaaccgtcgttttgcactctgttccaatataa

SEQ ID NO: 515 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggagttgatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 516 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagaatgaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 517 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgatcccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 518 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgtcaacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 519 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccaaacttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 520 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctccatgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 521 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctacaccaatataa

SEQ ID NO: 522 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgttgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 523 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagattgcttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 524 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgactacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 525 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgagagtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 526 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttgggtccaggattaactgtcgaaaccgtcgttttgcactctgttccaatataa

SEQ ID NO: 527 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctatcatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 528 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaacaggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 529 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtattggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 530 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtatggaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 531 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctggaagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 532 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccaggtatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 533 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaacaagaaggtaaggctacaaccggtgagggtttagactggggtgttttgttcggcttcggtccaggattaactgtcgaaaccgtcgttttgcactctgttccaatataa

SEQ ID NO: 534 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgcttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 535 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtacatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 536 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatgggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 537 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtggtctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 538 - DNA, 1173 bp, Artificial Sequence
  Synthetic
atgcccagtttagagtcagttaagaaatccaatcgtgccgacggcttcgcatcgattctggctataggtagagctaaccctccaaactttatcgaacagtctacatatccagatttctacttcagagtcaccaatagcgaacaccttgtagatctaaaggaaaagttccaaagaatttgcgacaagactgctatcaggaagcgtcattttgtgtggaacgaagaattgttgaatgcccacccagaaatttgtacgtacatggctccatcattagatgtcagacaagaaatggctagaagagagattccaaaactaggtgctgaagctgcccaaaaggcaatccaagaatggggtcaaccaaagtccaaaataacccacttgatcttctgtactacctctggaatggatatgccaggtgctgactaccaattgacccaattgctgggtttgcctcctaatattgagagggttatgttataccagcaaggttgtttcgctggtggtactactttgagattggccaaagatttagccgaaaaccgtccaggagctagagttttggttgtctgtgctgaaacaaccgctgttctattcagagcaccttccgaagaacatttggatgatttagtaactcaagctttgttcgccgacggtgcttctgctcttatcgttggtgcagacccagacgagactgccaacgaaagagctttttttgttattgtctctacatctcaagtcttgttaccagatagcgaaggtgctatcggcggtcatgtgggtgaagccggtttgatcgccactttgcacagagatgttccacagatagttagcaaaaatgtcgagaagtgcttggaagaagcattcaagcccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagaatggggtgttttgttcggcttcggtccaggattaactgtcgaaaccgtcgttttgcactctgttccaatataa

SEQ ID NO: 539 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcgccttgggtccaggattaactgtcgaaaccgtcgttttgcactctgttccaatataa

SEQ ID NO: 540 - DNA, 1173 bp, Artificial Sequence
  Synthetic
atgcccagtttagagtcagttaagaaatccaatcgtgccgacggcttcgcatcgattctggctataggtagagctaaccctccaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgtgtacgtttatggatccatcattaaacgtcagacaagaatttgctattagagagattccaaaactaggtgctgaagctgccagaaaggcaatccaagaatggggtcaaccaaagtccagaataacccacttgatcttctgtactacctctggaatggatttgccaggtgctgactaccaattgacccaaattctgggtttgcctcctaatattgagagggttatgttataccagcaaggttgtttcgctggtggtactactttgagattggccaaagatttagccgaatctcgtaagggagctagagttttggttgtctgtgctgaaacaaccgctgttctattcagagcaccttccgaagaacatctggatgatttagtaactcaagctttgttcgccgacggtgcttctgctcttatcgttggtgcagacccagacgagactgcccacgaaagagctttttttgttattgtctctacatctcaagtcttgttaccagatagcgaaggtgctatcggcggtcatgtgtccgaaactggtttgatcgccactttgcacagagatgttccacagatagttagcaaaaatgtcgaaaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 541 - DNA, 1173 bp, Artificial Sequence
  Synthetic
atgcccagtttagagtcagttaagaaatccaatcgtgccgacggcttcgcatcgattctggctataggtagagctaaccctccaaactttatcgaacagtctacatatccagatttctacttcagagtcaccaatagcgaacaccttgtagatctaaaggaaaagttccaaagaatttgcgacaagactgctatcaggaagcgtcattttgtgtggaacgaagaattgttgaatgcccacccagagatttgtacgtacatggctccatcattagatgtcagacaagaaatggctagaagagagattccaaaactaggtgctgaagctgccgaaaaggcaatccaagaatggggtcaaccaaagtccaaaataacccacttgatcttctgtactacctctggaatggatatgccaggtgctgactaccaattgacccaattgctgggtttgcctcctaatattgagagggttatgttataccagcaaggttgtttcgctggtggtactactttgagattggccaaagacttagccgaaaaccgtccaggagctagagttttggttgtctgtgctgaaacaaccgctgttctattcagagcaccttccgaagaacatttggatgatttagtaactcaagctttgttcgccgacggtgcttctgctcttatcgttggtgcagacccagacgagactgccaacgaaagagctttttttgttattgtctctacatctcaagtcttgttaccagatagcgaaggtgctatcggcggtcatgtgggtgaagcaggtttgatcgccactttgcacagagatgttccacagatagttagcaaaaatgtcgaaaagtgcttggaagaagcattcaagcccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagaatggggtgttttgttcggcttcggtccaggattaactgtcgaaaccgtcgttttgcactctgttccaatataa

SEQ ID NO: 542 - DNA, 1173 bp, Artificial Sequence
  Synthetic
atgcccagtttagagtcagttaagaaatccaatcgtgccgacggcttcgcatcgattctggctataggtagagctaaccctccaaactttatcgaacagtctacatatccagatttctttttcagagtcaccaatagcgaacaccttgtagatctaaaggaaaagttccaaagaatttgcgacaagactgctatcaggaagcgtcattttgtgtggaacgaagaattgttgaatgcccacccagaaatttgtacgtacatggctccatcattagatgtcagacaagaaatggctagaagagagattccaaaactaggtgctgaagctgccgaaaaggcaatccaagaatggggtcaaccaaagtccaaaataacccacttgatcttctgtactacctctggaatggatatgccaggtgctgactaccaattgacccaattgctgggtttgcctcctaatattgagagggttatgttataccagcaaggttgtttcgctggtggtactactttgagattggccaaagatttagccgaaaaccgtccaggagctagagttttggttgtctgtgctgaaacaaccgctgttctattcagagcaccttccgaagaacatcttgatgatttagtaactcaagctttgttcgccgacggtgcttctgctcttatcgttggtgcagacccagacgagactgccaacgaaagagctttttttgttattgtctctacatctcaagtcttgttaccagatagcgaaggtgctatcggcggtcatgtgggtgaagctggtttgatcgccactttgcacagagatgttccacagatagttagcaaaaatgtcgagaagtgcttggaagaagcattcaagcccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagaatggggtgttttgttcggcttcggtccaggattaactgtcgaaaccgtcgttttgcactctgttccaatataa

SEQ ID NO: 543 - DNA, 1173 bp, Artificial Sequence
  Synthetic
atgcccagtttagagtcagttaagaaatccaatcgtgccgacggcttcgcatcgattctggctataggtagagctaaccctccaaactttatcgaacagtctacatatccagatttctttttcagagtcaccaatagcgaacaccttgtagaactaaagaaaaagttccaaagaatttgcgacaagactgctatcaggaagcgtcattttgtgtggaacgaagaattgttgaatgcccacccagaaatttgtacgtacatggcaccatcattagatgtcagacaagaaatggctagaagagagattccaaaactaggtgctgaagctgccagaaaggcaatccaagaatggggtcaaccaaagtccaaaataacccacttgatcttctgtactacctctggaatggatatgccaggtgctgactaccaattgacccaattgctgggtttgccccctaatattgagagggttatgttataccagcaaggttgtttcgctggtggtactactttgagattggccaaagatttagccgaaaaccgtccaggagctagagttttggttgtctgtgctgaaacaaccgctgttctattcagagcaccttccgaagaacatttggatgatttagtaactcaagctttgttcgccgacggtgcttctgctcttatcgttggtgcagacccagacgagactgccaacgaaagagctttttttgttattgtctctacatctcaagtcttgttaccagatagcgaaggtgctatcggcggtcatgtgggtgaagctggtttgatcgccactttgcacagagatgttccacagatagttagcaaaaatgtcgaaaagtgcttggaagaagcattcaagcccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagaatggggtgttttgttcggcttcggtccaggattaactgtcgaaaccgtcgttttgcactctgttccaatataa

SEQ ID NO: 544 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttatgttgttcacaacggaggtccaacgattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 545 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatgggcggtcatgtgtccgaaggtggtttgatctatactttgcacagagatgttccacagatagttagcaaaaatgtcggtaagtgcttggaagaagcattcacccccttgggtattagtgattggaacagtattttttacgttgtacacaacggaggtccaaccattcttgaccaagtggaagaaagagtcggtttaaagcctgagaagttgatcgtatccagacatgtgttagccgaatatggcaacatgtggtctccatgtgttcactttgctctggatgaaatgaggaagagatctaaaaaagaaggtaaggctacaaccggtgagggtttagactggggtgttttgttcgctttgggtccaggattaactgtcgaaaccgtcgttttgcactctgttccaatataa

SEQ ID NO: 546 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatctacactttgcacagagatgttccacagatagttagcaaaaatgtcggtaagtgcttggaagaagcattcacccccttgggtattagtgattggaacagtattttttgggttccacacaacggaggtagagctattcttgaccaagtggaagaaagagtcggtttaaagcctgagaagttgatcgtatccagacatgtgttagccgaatatggcaacatgtggtctccatgtgttcactttgctctggatgaaatgaggaagagatctaaaaaagaaggtaaggctacaaccggtgagggtttagactggggtgttttgttcgcattgggtccaggattaactgtcgaaaccgtcgttttgcactctgttccaatataa

SEQ ID NO: 547 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatctatactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtggtctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 548 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatctacactttgcacagagatgttccacagatagttagcaaaaatgtcggtaagtgcttggaagaagcattcacccccttgggtattagtgattggaacagtattttttgggttccacacaacggaggtagagctattcttgaccaagtggaagaaagagtcggtttaaagcctgagaagttgatcgtatccagacatgtgttagccgaatatggcaacatgtggtctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 549 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLDVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 550 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVAHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 551 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPGKLIVSRHVLAEYGNMSSVCVHFALDEMRKRSKKEGKATTGEGLDWGVLFGFGPGLTVETVVLHSVPI

SEQ ID NO: 552 - protein, 390 aa, Artificial Sequence; identical to SEQ ID NO: 323
  Synthetic

SEQ ID NO: 553 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPKIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 554 - protein, 390 aa, Artificial Sequence
  Synthetic
MPSLESVKKSKRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 555 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEMFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 556 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFAPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 557 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQIEERVGLKPEKLIVSRHVLAEYGNMSSVCVHFALDEMRKRSKKEGKATTGEGLDWGVLFGFGPGLTVETVVLHSVPI

SEQ ID NO: 558 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQLLGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 559 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVEKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 560 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPQ

SEQ ID NO: 561 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNENPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 562 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQRFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 563 - protein, 390 aa, Artificial Sequence
  Synthetic
MPSLESVKKSNRADGFASILAIGRANPENFIRQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 564 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRPGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 565 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPYGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 566 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGRATTGEGLDWGVLFGFGPGLTVETVVLHSVPI

SEQ ID NO: 567 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLEPEKLIVSRHVLAEYGNMSSVCVHFALDEMRKRSKKEGKATTGEGLDWGVLFGFGPGLTVETVVLHSVPI

SEQ ID NO: 568 - protein, 390 aa, Artificial Sequence
  Synthetic
MPSLESVKKSNRADGFASILAIGRANPENFIEQSTYPDFYFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 569 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVGEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 570 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFKPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 571 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADTQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 572 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLGQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 573 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFSPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 574 - protein, 390 aa, Artificial Sequence
  Synthetic
MPSLESVKKSNRADGFASILAIGRANPENFIEQSTYPDFFFRVTNSEHLVELKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 575 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFQPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 576 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPN

SEQ ID NO: 577 - protein, 390 aa, Artificial Sequence
  Synthetic
MPSLESVKKSNRADGFASILAIGRANPENCIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 578 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGLEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 579 - protein, 390 aa, Artificial Sequence
  Synthetic
MPSLESVKKSNRTDGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 580 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIQRVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 581 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEMAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 582 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERAFFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 583 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPWGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 584 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIDEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 585 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLEWGVLFGFGPGLTVETVVLHSVPI

SEQ ID NO: 586 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLEANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 587 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAAQKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 588 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSNITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 589 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFGPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 590 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFATREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 591 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSKITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 592 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYFQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 593 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPHKLIVSRHVLAEYGNMSSVCVHFALDEMRKRSKKEGKATTGEGLDWGVLFGFGPGLTVETVVLHSVPI

SEQ ID NO: 594 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVVHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 595 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAISEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 596 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSEGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 597 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATRAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 598 - protein, 390 aa, Artificial Sequence
  Synthetic
MPSLESVKKSNRVDGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 599 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGVSDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 600 - protein, 390 aa, Artificial Sequence
  Synthetic
MPSLESVKKSNRADGFASILAIGRANPENFIEQETYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 601 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGADLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 602 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSASQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 603 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEETVGLKPEKLIVSRHVLAEYGNMSSVCVHFALDEMRKRSKKEGKATTGEGLDWGVLFGFGPGLTVETVVLHSVPI

SEQ ID NO: 604 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQAFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 605 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAAREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 606 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQSDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 607 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIASRHVLAEYGNMSSVCVHFALDEMRKRSKKEGKATTGEGLDWGVLFGFGPGLTVETVVLHSVPI

SEQ ID NO: 608 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELINANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 609 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDPSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 610 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERTMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 611 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFARREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 612 - protein, 390 aa, Artificial Sequence
  Synthetic
MPSLESVKKSNRADGFASILAIGRANPENFIEQSTYPDFFFRVTNSEHLVNLKKRFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 613 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAEREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 614 - protein, 390 aa, Artificial Sequence
  Synthetic
MPSLESVKKRNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 615 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHNGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 616 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERIMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 617 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPQLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 618 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDMPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 619 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDNLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 620 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGFIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 621 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREAPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 622 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHLDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 623 - protein, 390 aa, Artificial Sequence
  Synthetic
MPSLESVKKSNRADGFASILAIGRANPENFIEQSTYPDFFFRVTNSEHLVDLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 624 - protein, 390 aa, Artificial Sequence
  Synthetic
MPSLESVKKSNRADGFASILAIGRANPENFIEQSTYPDFFFRVTNSEHLVNLKKKFQRICDKTAIRKRHFVWNEELLNANPCLGTFMDNSLNVRQEFAKREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 625 - protein, 390 aa, Artificial Sequence
  Synthetic
MPSLESVKKSNRNDGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 626 - protein, 390 aa, Artificial Sequence
  Synthetic
MPSLESVKKNNRADGFASILAIGRANPENFIEQSTYPDFFFRVTNSEHLVNLKKKFQRICDKTAIRKRHFVWNEELLNANPCLGTFMDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 627 - protein, 385 aa, Artificial Sequence; identical to SEQ ID NO: 207
  Synthetic

SEQ ID NO: 628 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattagacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 629 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttgctcacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 630 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctggaaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 631 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgccacctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 632 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccaaagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 633 - DNA, 1173 bp, Artificial Sequence
  Synthetic
atgcccagtttagagtcagttaagaaatccaagcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 634 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaaatgttcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 635 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcgctcccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 636 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaaatcgaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 637 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaattactgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 638 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcgaaaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 639 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccacaataa

SEQ ID NO: 640 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgaaaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 641 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaaagatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 642 - DNA, 1173 bp, Artificial Sequence
  Synthetic
atgcccagtttagagtcagttaagaaatccaatcgtgccgacggcttcgcatcgattctggctataggtagagctaaccctgaaaactttatcagacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 643 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtcctggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 644 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcaccccctatggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 645 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtcgtgctacaaccggtgagggtttagactggggtgttttgttcggcttcggtccaggattaactgtcgaaaccgtcgttttgcactctgttccaatataa

SEQ ID NO: 646 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttagagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 647 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctacttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 648 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgggtgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 649 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcaagcccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 650 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgacactcaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 651 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttaggacagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 652 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattctcacccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 653 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtagaactaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 654 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattccaacccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 655 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaaactaa

SEQ ID NO: 656 - DNA, 1173 bp, Artificial Sequence
  Synthetic
atgcccagtttagagtcagttaagaaatccaatcgtgccgacggcttcgcatcgattctggctataggtagagctaaccctgaaaactgcatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 657 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtttggaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 658 - DNA, 1173 bp, Artificial Sequence
  Synthetic
atgcccagtttagagtcagttaagaaatccaatcgtacagacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 659 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattcaaagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 660 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaaatggctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 661 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctttctttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 662 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcaccccctggggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 663 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatcgatgaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 664 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagaatggggtgttttgttcggcttcggtccaggattaactgtcgaaaccgtcgttttgcactctgttccaatataa

SEQ ID NO: 665 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttggaagccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 666 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgcccaaaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 667 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccaatataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 668 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcggacccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 669 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctactagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 670 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccaaaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 671 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttatacttccaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 672 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctcataagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 673 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttgtccacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 674 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatctccgaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 675 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgaaggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 676 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactagagcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 677 - DNA, 1173 bp, Artificial Sequence
  Synthetic
atgcccagtttagagtcagttaagaaatccaatcgtgtcgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 678 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtgttagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 679 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacaggaaacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 680 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggagctgatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 681 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctgcttctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 682 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaactgtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 683 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagcttttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 684 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctgctagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 685 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaatctgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 686 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgcttccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 687 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgattaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 688 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggatccatcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 689 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagaggactatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 690 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctagaagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 691 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaagattccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 692 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctgagagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 693 - DNA, 1173 bp, Artificial Sequence
  Synthetic
atgcccagtttagagtcagttaagaaacgtaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 694 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacaacggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 695 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagaggatcatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 696 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccacaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 697 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatatgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 698 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagataacttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 699 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttcatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 700 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagaggctccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 701 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatttagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 702 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtagacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 703 - DNA, 1173 bp, Artificial Sequence
  Synthetic
atgcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctaaaagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 704 - DNA, 1173 bp, Artificial Sequence
  Synthetic
atgcccagtttagagtcagttaagaaatccaatcgtaacgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 705 - DNA, 1173 bp, Artificial Sequence
  Synthetic
atgcccagtttagagtcagttaagaaaaataatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

SEQ ID NO: 706 - DNA, 1158 bp, Artificial Sequence; identical to SEQ ID NO: 250
  Synthetic

SEQ ID NO: 707 - protein, 608 aa, Artificial Sequence
  Synthetic
MEQKLISEEDLVQIIHKAPLGDMAESELFYGSIPDFMRSSRFADDDTRISVVDYDTDKAMTLARVFKVSGMLRAQFFHTYDVGKKKDGDANPKVIFYVGNTADNLACHIALHDLGAIISPASTAYDVNDLLHQINVVDAALIVAEAARADVAREAVAKAGDKFKHVKVVVFEELLEQNRRVRPNLIRVAPIVHLSKEQAYTTLAYLGMSSGTSGGVPKAVELTHFAMTSNVQQTAKNAPNLVDDDTVCSAVIPTSHIYGLALFMLHMPFLGAKVVYHKKFDLVEMLEGQKKHGVNYWVLVPPIIVALAKHPIIDRYLDSIRANLKTITSGAAPLGGNVVDAVQTRFTGNTRGTLPNNRRIVIYQGYGLTETAPIACLCDPLWDNLNVVTVGTLVPNTEARIVDENGDDQPAFEVTDARALGDAVRRGDKIPSGELYLRGPQIMSGYHKNPKSTEESFEYVDYKAEGLRHYQDRWLKTGDVAVIDNFGRIQIVDRTKELIKSMSKQVAPAELEALLLSHPDVVDVAVIGVWQEEKATESARAFLVVRDPKVDVVAIKKWMDEQVPSYKRLYGGVVVIDAIPKNPSGKILRRLLRQRKDDVVQGLDQAKL

SEQ ID NO: 708 - protein, 607 aa, Artificial Sequence
  Synthetic
MEQKLISEEDLTQIIHNATIPNIPVDQLYDGKITDFIRSGGHSNETKPSVIDAKTGQTLSQAEMWQLSDKYAALLSSQYGLCRHRDNELDPSMGDVLITFFGNVILAPVVHWAALDLGATISPGSTGYSAQDLAHQFRVTTPKVVVYAKAFKDVVDEATKLYNSPNPPALVELEALDKQARMVGNHKVEHTRKIKLAPHESRTRIAYLGMSSGTSGGVSKAVRLTHSNLTSCSEISNKASESLATDQQIAAAIIPVSHLFGLSKFLIGNPHAGATTVYHNGFDLIEVLEAQKKYKVNSWTLVPPIIVLLTKHPIVEKYIPSLRAHMRAILSGAAPLGANVTEALLTRVTGNKFGESPEGGLRIVQGYGLTETSPVATLFDPEDKERHIRSCGKLVPNSQVRIVNEDGVDQPAYDVDPNELDEAIKQGTLPVGELWIRGPQVMDGYHNNPEANEACFVKADDAEADTAYYNRHWFRTGDVALVDKQGRYMIVDRTKEMIKSQGKQVAPAELEDMLLGHAQVADTAVIGIQDVEKGNEAPRAFVVLKDPKYDAVEIKTWLDKQLPKYKQLHAGIVVIDAIPKNASGKILRRLLRARKDDVVLGLNKAKL

SEQ ID NO: 709-711 - skipped (3 entries)

SEQ ID NO: 712 - DNA, 1827 bp, Artificial Sequence
  Synthetic
atggaacagaaactcattagcgaagaagatctcgtacagattattcataaggctccgttaggcgatatggccgagtccgaacttttctatggatcgattcccgattttatgcgctcgagccgcttcgcagacgatgatacccgtattagcgtggtggattacgataccgacaaggctatgacattagctcgcgtttttaaggtcagtggcatgctgcgtgctcaattcttccacacatacgatgtcggcaaaaaaaaggacggtgatgcaaacccaaaagtaatcttttacgttggcaacacggccgataacctggcctgtcacattgcgctccatgacttaggcgccattattagcccggcgtccaccgcctatgacgtaaacgatttattgcaccagattaacgtggtagatgcagccctgattgtagcggaggcggcgcgtgcagatgtcgcccgcgaggcagtagcgaaggcgggagataagtttaagcatgtgaaagtggttgtttttgaagaactcctggaacagaaccgccgcgttcgcccgaatctcattcgtgtcgccccgatcgttcatctcagcaaagagcaagcctacaccaccttagcatacctgggaatgagctcaggtacgagtggcggggtgccgaaagccgttgaattaacccatttcgccatgacctcaaatgtccagcaaacggcgaaaaatgctccaaatctggtagatgacgacactgtttgcagcgcagtgattccaacttcgcacatttatggtctggcgctgtttatgcttcatatgccgtttttaggggccaaagttgtttaccataaaaaattcgatctggtagaaatgttagagggccagaaaaaacatggcgtcaattactgggtgttggtgccgcccattattgttgccttagcaaaacaccccatcattgatcgctatcttgactcgattcgtgcgaatctcaagacaattaccagcggggcggcgccattgggcggtaacgtagtagacgcagtccagacacgctttaccgggaatacccgcggtacattgcctaataaccgccgcattgttatttatcaagggtacggcttaacagaaaccgcccccattgcttgtttgtgtgatccgctgtgggacaacttaaacgtagtgaccgtgggcacgctggtcccgaacacggaggctcgcatcgtggatgaaaatggcgatgatcaaccagcattcgaggtgaccgatgcccgtgcgctgggtgatgctgtgcgccgcggagataagatccccagcggcgaactgtaccttcgcggcccgcagatcatgtccggctaccacaaaaacccgaaaagcaccgaggagtcctttgaatacgtcgattacaaggccgagggcttacgtcactaccaggaccgttggttaaagaccggagatgttgcagtaattgacaactttggacgtattcagatcgtggaccgtacgaaagagctgatcaagagcatgagtaagcaggtcgcgccggcggaactggaggcccttcttctgtctcatccggatgtagtagatgtcgcggtcattggggtctggcaggaagaaaaagctaccgaatccgcccgtgcgttcttagtcgttcgtgacccgaaagtggatgttgtcgcgatcaaaaaatggatggatgaacaagtcccgtcctataagcgcctgtacggaggggtggtcgtaattgacgccattccgaagaatccgagtggcaagatactgcgccgcttactccgccagcgcaaagatgatgttgtacaaggccttgatcaagcaaagctctaa

SEQ ID NO: 713 - DNA, 1824 bp, Artificial Sequence
  Synthetic
atggaacagaaactcattagcgaagaagatctcacccagatcatccataacgcaacaatccctaatataccggtggatcaactgtacgacggcaagattaccgattttattcgcagtggcgggcatagcaatgaaaccaaaccgtcagtgattgacgcaaaaaccggtcaaaccctgagccaggcggaaatgtggcagctgagcgataaatacgccgcgctcctgtcatcacagtacgggttatgtcgtcaccgtgataacgagctggatccatccatgggcgatgtactgatcaccttctttggtaatgtcatccttgcaccggtagtccactgggctgccctggacctgggcgctacgatttcgccgggctcgaccggttattcagctcaagatctcgctcatcagtttcgtgttacgaccccgaaagttgtggtgtacgccaaggcctttaaggacgtggttgatgaagccaccaagctgtacaacagcccaaatccccctgcgctggtggaactggaagccttggataagcaagcccgcatggtcggcaaccacaaagttgagcacactcgcaaaattaaattggcccctcacgagtcgcgcactcgcattgcttacctgggcatgtcgagtggtacatcgggcggcgtttcaaaagctgttcgtctgacacacagtaacttaacatcctgttcagaaattagtaataaggcgtccgaaagcctagcgacggatcaacagatcgcggcggccattatcccggtgtcccatctgttcggcctttcaaagttcctgattggcaatcctcatgcgggcgcaaccaccgtgtatcataatggttttgacctcattgaagtcctcgaagcccagaaaaaatacaaagtgaactcatggaccttagtgccgccaattatcgtgttactaacaaagcatccgatcgttgaaaagtacatcccatcactacgtgctcatatgcgtgccatccttagcggcgcggcgccgcttggggccaatgttacagaagcgctgctgacgcgtgtcaccggcaacaaattcggggagtctccagagggcggattacgtattgtccagggctacggcctcaccgaaacctcacctgttgcaacgttatttgatccggaggacaaagagcgccacatccgtagctgcggcaagttagtgcctaatagccaagtccgtattgtgaatgaagatggtgtagaccagccggcgtatgacgttgacccgaacgaactggacgaagccattaaacagggcacgctgccggtgggtgagctttggattcgcggcccgcaggttatggacggttaccataacaatcccgaagcgaacgaggcatgtttcgttaaagccgacgatgcagaagcagataccgcatactataaccgccactggtttcgcaccggagacgtggctctggtagataaacagggccgctatatgattgtagatcgtacaaaagaaatgatcaaatctcagggaaaacaggttgcgccggctgaactggaggacatgctgcttggccatgcgcaggttgcggataccgcggtgatcgggatccaggatgtcgaaaaaggaaatgaagcgccacgcgcattcgtggtgctgaaggacccaaaatacgacgcagttgaaatcaaaacctggctcgataaacagttacccaaatacaaacaacttcatgcggggattgtggtgatcgatgccatcccgaagaacgcctcgggtaaaattcttcgccgcctgctccgtgcgcgcaaggatgatgtggtgttagggctgaacaaggcaaagctctaa

SEQ ID NO: 714 - protein, 304 aa, Artificial Sequence
  Synthetic
MDNSLNVRQEFAIREIPKLGAEAATKAIQEWGQPKSRITHLIFCTTSGMDLPGADYQLTQILGLNPNIERVMLYQQGCFAGGTTLRLAKCLAESRKGARVLVVCAETTAVLFRAPSEEHQDDLVTQALFADGASALIVGADPDETAHERASFVIVSTSQVLLPDSAGAIGGHVSEGGLIATLHRDVPQIVSKNVGKCLEEAFTPLGISDWNSIFWVPHPGGRAILDQVEERVGLKPEKLIVSRHVLAEYGNMSSVCVHFALDEMRKRSKKEGKATTGEGLDWGVLFGFGPGLTVETVVLHSVPI

SEQ ID NO: 715 - DNA, 1171 bp, Artificial Sequence
  Synthetic
gcccagtttagagtcagttaagaaatccaatcgtgccgacggcttcgcatcgattctggctataggtagagctaaccctgaaaactttatcgaacagtctacatatccagatttctttttcagagtcaccaatagcgaacaccttgtaaacctaaagaaaaagttccaaagaatttgcgacaagactgctatcaggaagcgtcattttgtgtggaacgaagaattgttgaatgccaacccatgtttgggtacgtttatggataactcattaaacgtcagacaagaatttgctattagagagattccaaaactaggtgctgaagctgccactaaggcaatccaagaatggggtcaaccaaagtccagaataacccacttgatcttctgtactacctctggaatggatttgccaggtgctgactaccaattgacccaaattctgggtttgaatcctaatattgagagggttatgttataccagcaaggttgtttcgctggtggtactactttgagattggccaaatgtttagccgaatctcgtaagggagctagagttttggttgtctgtgctgaaacaaccgctgttctattcagagcaccttccgaagaacatcaagatgatttagtaactcaagctttgttcgccgacggtgcttctgctcttatcgttggtgcagacccagacgagactgcccacgaaagagctagttttgttattgtctctacatctcaagtcttgttaccagatagcgctggtgctatcggcggtcatgtgtccgaaggtggtttgatcgccactttgcacagagatgttccacagatagttagcaaaaatgtcggtaagtgcttggaagaagcattcacccccttgggtattagtgattggaacagtattttttgggttccacacccaggaggtagagctattcttgaccaagtggaagaaagagtcggtttaaagcctgagaagttgatcgtatccagacatgtgttagccgaatatggcaacatgtcttctgtttgtgttcactttgctctggatgaaatgaggaagagatctaaaaaagaaggtaaggctacaaccggtgagggtttagactggggtgttttgttcggcttcggtccaggattaactgtcgaaaccgtcgttttgcactctgttccaatataa

The invention claimed is:

1. A method for producing a cannabinoid compound or a cannabinoid precursor comprising culturing a host, cell that comprises a heterologous polynucleotide encoding a polyketide synthase (PKS), wherein the PKS comprises an amino acid sequence that has at least 95% sequence identity to SEQ ID NO: 7, wherein the cannabinoid compound is a compound of Formulas 8, 9, 10, or 11:

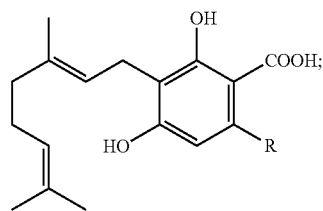
(8)

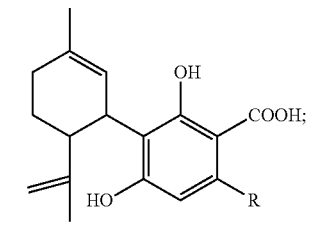
(9)

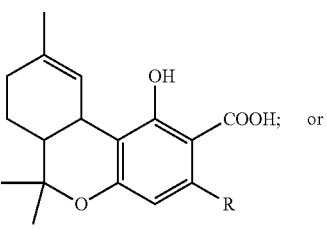
(10)

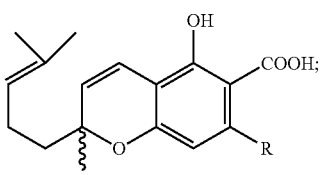
(11)

or a pharmaceutically acceptable salt, solvate, hydrate, polymorph, co-crystal, tautomer, stereoisomer, isotopically labeled derivative, or prodrug thereof;

wherein the cannabinoid precursor is a compound of Formulas 4, 5, or 6:

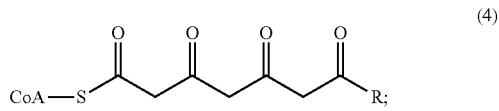
(4)

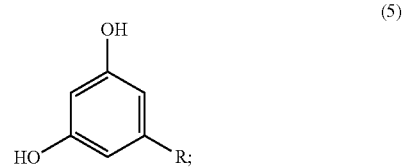
(5)

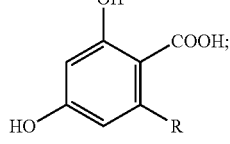
(6)

or a pharmaceutically acceptable salt, solvate, hydrate, polymorph, co-crystal, tautomer, stereoisomer, isotopically labeled derivative, or prodrug thereof;

wherein R is straight-chain unsubstituted $C_{1-20}$ alkyl, and wherein the host cell is not a mammalian cell.

2. The method of claim 1, wherein relative to the sequence of SEQ ID NO: 7, the PKS comprises an amino acid substitution at a residue corresponding to position 28, 34, 50, 70, 71, 76, 88, 100, 151, 203, 219, 285, 359, and/or 385 in SEQ ID NO: 7.

3. The method of claim 1, wherein the PKS comprises:
  a) the amino acid P at a residue corresponding to position 28 in SEQ ID NO: 7;
  b) the amino acid Q at a residue corresponding to position 34 in SEQ ID NO: 7;
  c) the amino acid N at a residue corresponding to position 50 in SEQ ID NO: 7;
  d) the amino acid M at a residue corresponding to position 70 in SEQ ID NO: 7;
  e) the amino acid Y at a residue corresponding to position 71 in SEQ ID NO: 7;
  f) the amino acid I at a residue corresponding to position 76 in SEQ ID NO: 7;
  g) the amino acid A at a residue corresponding to position 88 in SEQ ID NO: 7;
  h) the amino acid P or T at a residue corresponding to position 100 in SEQ ID NO: 7;
  i) the amino acid P at a residue corresponding to position 151 in SEQ ID NO: 7;
  j) the amino acid K at a residue corresponding to position 203 in SEQ ID NO: 7;
  k) the amino acid C at a residue corresponding to position 219 in SEQ ID NO: 7;

l) the amino acid A at a residue corresponding to position 285 in SEQ ID NO: 7, m) the amino acid M at a residue corresponding to position 359 in SEQ ID NO: 7; and/or n) the amino acid M at a residue corresponding to position 385 in SEQ ID NO: 7.

4. The method of claim 1, wherein the PKS comprises one or more of the following amino acid substitutions relative to SEQ ID NO: 7: V71Y and F70M.

5. The method of claim 1, wherein the PKS comprises:

a) C at a residue corresponding to position 164 in SEQ ID NO: 7;

b) H at a residue corresponding to position 304 in SEQ ID NO: 7; and/or c) N at a residue corresponding to position 337 in SEQ ID NO: 7.

6. The method of claim 1, wherein the PKS comprises SEQ ID NO: 7.

7. The method of claim 1, wherein the host cell is capable of producing 3,5,7-trioxododecanoyl-CoA, olivetol, olivetolic acid, cannabigerolic acid (8a), cannabidiolic acid (9a), tetrahydrocannabinolic acid (10a), and/or cannabichromenic acid (11a).

8. The method of claim 7, wherein the host cell is capable of producing more 3,5,7-trioxododecanoyl-CoA, olivetol, and/or olivetolic acid than a host cell that expresses a PKS that comprises SEQ ID NO: 5.

9. The method of claim 1, wherein the heterologous polynucleotide comprises a nucleotide sequence that has at least 95% sequence identity to SEQ ID NO: 38 or 176.

10. The method of claim 1, wherein the host cell is a yeast cell.

11. The method of claim 10, wherein the yeast cell is a *Saccharomyces* ceil, a *Yarrowia* cell, a *Pichi* a cell or a *Komagataella* cell.

12. The method of claim 11, wherein the *Saccharomyces* cell is a *Saccharomyces cerevisiae* cell.

13. The method of claim 1, wherein the host cell further comprises one or more heterologous polynucleotides encoding one or more of: an acyl activating enzyme (AAE), a polyketide cyclase (PKC), a prenyltransferase (PT), and/or a terminal synthase (TS).

14. A method for producing a cannabinoid compound or a cannabinoid precursor comprising culturing a host cell that comprises a heterologous polynucleotide encoding a polyketide synthase (PKS), wherein the PKS comprises SEQ ID NO: 7 or a conservatively substituted version thereof, wherein the cannabinoid compound is a compound of Formulas 8, 9, 10, or 11:

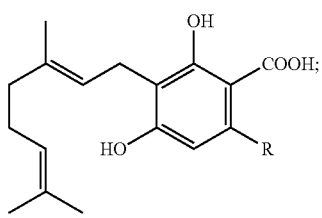

(8)

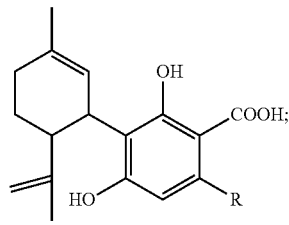

(9)

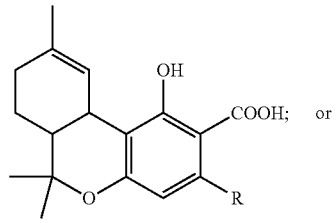

(10)

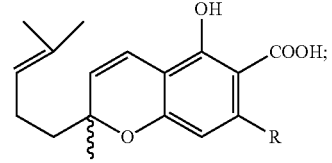

(11)

or a pharmaceutically acceptable salt, solvate, hydrate, polymorph, co-crystal, tautomer, stereoisomer, isotopically labeled derivative, or prodrug thereof:

wherein the cannabinoid precursor is a compound of Formulas 4, 5, or 6:

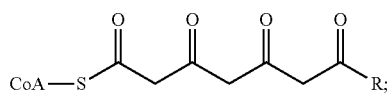

(4)

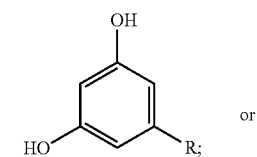

(5)

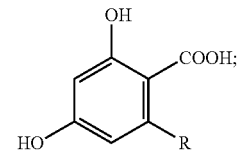

(6)

or a pharmaceutically acceptable salt, solvate, hydrate, polymorph, co-crystal, tautomer, stereoisomer, isotopically labeled derivative, or prodrug thereof:

wherein R is straight-chain unsubstituted $C_{1-20}$ alkyl, and wherein the host cell is not a mammalian cell.

15. The method of claim 14, wherein the host cell is capable of producing 3,5,7-trioxododecanoyl-CoA, olivetol, olivetolic acid, cannabigerolic acid (8a), cannabidiolic acid (9a), tetrahydrocannabinolic acid (10a), and/or cannabichromenic acid (11a).

16. The method of claim 15, wherein the host cell produces more 3,5,7-trioxododecanoyl-CoA, olivetol, and/or olivetolic acid than a host cell that expresses a PKS that comprises SEQ ID NO: 5.

17. The method of claim 14, wherein the host, cell is a yeast, cell.

18. The method of claim 17, wherein the yeast cell is a *Saccharomyces* ceil, a *Yarrowia* cell, a *Pichi* a cell or a *Komagataella* cell.

19. The method of claim 18, wherein the *Saccharomyces* cell is a *Saccharomyces cerevisiae* cell.

20. The method of claim 14, wherein the host cell further comprises one or more heterologous polynucleotides encoding one or more of: an acyl activating enzyme (AAE), a polyketide cyclase (PKC), a prenyltransferase (PT), and/or a terminal synthase (TS).

\* \* \* \* \*

UNITED STATES PATENT AND TRADEMARK OFFICE
CERTIFICATE OF CORRECTION

PATENT NO. : 11,274,320 B2
APPLICATION NO. : 17/078872
DATED : March 15, 2022
INVENTOR(S) : Kim Cecelia Anderson et al.

It is certified that error appears in the above-identified patent and that said Letters Patent is hereby corrected as shown below:

In the Claims

In Claim 1, at Column 229, Line 17: "a host, cell that" should be replaced to read --a host cell that--

In Claim 3, at Column 231, Line 2: "285 in SEQ ID NO: 7," should be replaced to read --285 in SEQ ID NO: 7;--

In Claim 11, at Column 231, Line 39, "*Saccharomyces* ceil" should be replaced to read --*Saccharomyces* cell--

In Claim 11, at Column 231, Line 39: "*Pichi* a cell" should be replaced to read --*Pichia* cell--

In Claim 14, at Column 232, Line 31: "labeled derivative, or prodrug thereof:" should be replaced to read --labeled derivative, or prodrug thereof;--

In Claim 14, at Column 232, Line 56: "labeled derivative, or prodrug thereof:" should be replaced to read --labeled derivative, or prodrug thereof;--

In Claim 17, at Column 233, Lines 1-2: "wherein the host, cell is a yeast, cell" should be replaced to read --wherein the host cell is a yeast cell--

In Claim 18, at Column 233, Line 4, "*Saccharomyces* ceil" should be replaced to read --*Saccharomyces* cell--

In Claim 18, at Column 233, Line 4: "*Pichi* a cell" should be replaced to read --*Pichia* cell--

Signed and Sealed this
Fifteenth Day of November, 2022

Katherine Kelly Vidal
*Director of the United States Patent and Trademark Office*